United States Patent
Vemuri et al.

(10) Patent No.: US 12,234,495 B2
(45) Date of Patent: *Feb. 25, 2025

(54) SYNTHESIS OF BETA-HYDROXYISOVALERATE AND METHODS OF USE

(71) Applicant: Sasya Inc., St. Paul, MN (US)

(72) Inventors: Goutham Vemuri, Maple Grove, MN (US); Christopher Lindsay, St. Paul, MN (US); Kevin Roberg-Perez, Minneapolis, MN (US); Christopher D. Snow, St. Paul, MN (US); Elizabeth A. Cameron, New Brighton, MN (US)

(73) Assignee: Sasya Inc., St. Paul, MN (US)

(*) Notice: Subject to any disclaimer, the term of this patent is extended or adjusted under 35 U.S.C. 154(b) by 0 days.

This patent is subject to a terminal disclaimer.

(21) Appl. No.: 17/658,214

(22) Filed: Apr. 6, 2022

(65) Prior Publication Data

US 2022/0325304 A1 Oct. 13, 2022

Related U.S. Application Data

(60) Provisional application No. 63/171,418, filed on Apr. 6, 2021.

(51) Int. Cl.

| *C12P 7/16* | (2006.01) |
|---|---|
| *C12N 1/20* | (2006.01) |
| *C12N 1/21* | (2006.01) |
| *C12N 9/04* | (2006.01) |
| *C12N 9/88* | (2006.01) |
| *C12N 15/52* | (2006.01) |

(52) U.S. Cl.
CPC ............... *C12P 7/16* (2013.01); *C12N 1/20* (2013.01); *C12N 9/0006* (2013.01); *C12N 9/88* (2013.01); *C12N 15/52* (2013.01); *C12Y 101/01086* (2013.01)

(58) Field of Classification Search
None
See application file for complete search history.

(56) References Cited

U.S. PATENT DOCUMENTS

2012/0220001 A1* 8/2012 Marliere ............... C12N 9/88
435/254.2

FOREIGN PATENT DOCUMENTS

| AU | 749323 B2 * | 5/1999 | ............. C12N 15/53 |
|---|---|---|---|
| CN | 111349644 A * | 6/2020 | ............. C12N 15/52 |

OTHER PUBLICATIONS

Uniprot, Accession No. A0A8J6FY38, 2022, www.uniprot.gov. (Year: 2022).*
Wang et al. (Improvement of L-Leucine Production in Corynebacterium glutamicum, Int. J. Molecular Sciences 20, 2019, 2020. (Year: 2019).*
Adlington, Stereochemistry of Hydroxylation During the Conversion of alpha-Ketoisocaproate to beta-Hydroxyisovalerate by 4-Hydroxyphenylpyruvate Dioxygenase, Bioorg. Med. Chem. Lett. 6, 1996, 2721-24. (Year: 1996).*
Lee et al., Control of fed-batch fermentations, Biotechnol. Adv. 17, 1999. 29-48. (Year: 1999).*
Gao et al., Biosynthesis of 3-Hydroxy-3-Methylbutyrate from L-Leucine by Whole-Cell Catalysis, Agricultural Food Chem. 69, 2021, 3712-19. (Year: 2021).*
Crouch et al., A Mechanistic Rationalisation for the Substrate Specificity of Recombinant Mammalian 4-Hydroxyphenylpyruvate Dioxygenase, Tetrahedron 53, 1997, 6993-7010. (Year: 1997).*

* cited by examiner

*Primary Examiner* — Todd M Epstein
(74) *Attorney, Agent, or Firm* — DeWitt LLP

(57) ABSTRACT

The biological production of beta-hydroxyisovalerate (βHIV) using at least one non-natural enzyme. The non-natural enzyme for the biologically-derived βHIV provides more beta-hydroxyisovalerate synthase activity than the wild-type parent. The non-natural enzyme having one or more modifications of substrate-specificity positions. The non-natural enzyme can be expressed in a microorganism, such as a yeast or bacteria, wherein the microorganism comprises an active βHIV metabolic pathway for the production of βHIV. Alternatively, the non-natural enzyme can be a βHIV synthase used to produce βHIV in a cell-free environment. The biological derivation of βHIV eliminates toxic by-products and impurities that result from the chemical production of βHIV, such that βHIV produced by a non-natural enzyme prior to any isolation or purification process has not been in substantial contact with any halogen-containing component.

20 Claims, 11 Drawing Sheets
Specification includes a Sequence Listing.

```
from numpy import log
from math import ceil
import sys
from pyclustalw import Aln, translateAA
from xlwt import Workbook, Font, XFStyle, easyxf

Settings particular to the multiple sequence alignment (MSA) of SEQ NOs 1-140
familyname = '4-hydroxyphenylpyruvate dioxygenase (HPPD)'
enzymeclass = 'dioxygenase'
entropyCuts = [0.05, 0.1, 0.2, 0.4]
alignment = 'curate1.aln 1
outfasta = 'curate1.fasta'
outputxls = 'curate1.xls'
Referencelabels = ['NP 058929.1/1-393']
V = True ## Verbose printing A = Aln(alignment)
A.WriteFasta(outfasta)
book = Workbook()
sheet = book.add_sheet('alignment')

styleO = easyxf('font: height 400, name Arial Black, color-index black, bold on; align: wrap on')
stylel = easyxf('font: height 300, name Arial, color-index black; align: wrap on')
style2 = easyxf('font: height 300, name Arial, color-index black, bold on; align: wrap on')
style3 = easyxf('font: height 250, name Arial, color-index black; align: wrap on')
style4 = easyxf('font: height 300, name Arial, color-index black, bold on')

At least half
minimum_num_aligned = ceil(A.N/2)

Reference_indices = [A.Iabel2i[label] for label in Reference_labels]

for refi, REF in enumerate(Referenceindices):
    REFname = Reference_labels[refi]

#print '\nThe parsed reference sequence (%s):  % (REFname)
    #print '\n'.join(A.data[REF])

print('\nThe full parsed reference sequence (%s) without gaps:  % (REFname))
    print(A.nogapseqs[REF])

Print the reference sequence residue id to MSA index dictionary for inspection
    #print '\nThe reference sequence residue indices map to the MSA indices like so:'
    #print A.index2masterindex[REF]

foo = input('Does the reference sequence(s) look OK? (Y/N)>')
if foo not in ['Y', 'y', 'yes']: sys.exit()

Determine how many members of the MSA place an amino acid at each site
NA = A.NumAliPos
numalignedat = dict( (j,0) for j in range(NA))
for i in range(A.N):
    for alignedpos in list(A.index2masterindex[i].values()): numalignedat[alignedpos] += 1

Determine which positions have enough sequences aligned for the downstream entropy calculation
commonpositions = sorted(i for i,num in list(numalignedat.items()) if num >= minimum_num_aligned)
```

FIGURE 5A

```
Create dictionaries that store the amino acid occurrence statistics for each each MSA site
aapops = dict( (mi,{}) for mi in range(NA))
nogapaapops = dict( (mi,{}) for mi in range(NA))
for mi in range(NA):
    for j in range(A.N):
        aa = A.fullseqs[j][mi]
        if aa in aapops[mi]: aapops[mi][aa] += 1
        else: aapops[mi][aa] = 1
        if aa == '-' : continue
        if aa in nogapaapops[mi]: nogapaapops[mi][aa] += 1
        else: nogapaapops[mi][aa] = 1

Define the sequence entropy calculation:   -P * ln(P)
def entropy(aapop):
    tot = sum(aapop.values())
    Ps = [float(v)/tot for v in list(aapop.values())]
    return sum(-p * log(p) for p in Ps)

Compute the sequence entropy (excluding gaps from the a.a. population)
print( 'Computing the sequence entropy' )
seqentropy = dict( (mi, entropy(aapop)) for mi, aapop in list(nogapaapops.items( ) ) )

For each MSA site, if there is a matching reference sequence residue ID, print the data to create the Table
sites_that_match_a_REF = set( )
for refi, REF in enumerate(Reference_indices):
    sites_that_match_a_REF.update(list(A.index2masterindex[REF].values( ) ) )

Run through to calculate entropy spreadsheet tab
sheet.write(0,0,'MSA index',style2)
for i,reflabel in enumerate(Reference_labels):
    sheet.write(0,2*i+1,reflabel + ' index',style2)
    sheet.write(0,2*i+2,reflabel + ' aa ',style2)
    sheet.col(2*i+2).width = 2000
sheet.write(0,2*i+3,'Entropy',style2)
sheet.write(0,2*i+5,'Observed amino acid distribution',style4)

row = 1
for mi in commonpositions:
    if mi in sites_that_match_a_REF:
        aapoplist = sorted(list(nogapaapops[mi].items()), key=lambda x:x[1],reverse=True)
        aareport = ', '.join('%s,%d'% (aa,aapop) for aa,aapop in aapoplist)

refcomps = [ ]
        for refi, REF in enumerate(Reference_indices):
            refseq = A.nogapseqs[REF]
            try:
                i = A.masterindex2index[REF][mi]
                refcomps.append( (i, refseq[i-1]) )
            except: refcomps.append( (-!,'-') )

csvline = '%d, ' % mi
        csvline += ','.join('%d, %s' % x for x in refcomps) + ',
        csvline += '%.3f, %s' % (seqentropy[mi], aareport)
        if V: print(csvline)
        sheet.write(row,0,mi) # MSA index
        for iii, (refind, refaa) in enumerate(refcomps):
            sheet.write(row,2*iii+1,refind) # Reference index
            sheet.write(row,2*iii+2,refaa) # Reference aa
```

FIGURE 5B

```
                sheet.write(row,2*iii+3, seqentropy[mi])
                for jjj, x in enumerate(aareport.split(' , ') ):
                    col = 2*iii + 5 + jjj
                    sheet.col(col).width = 1300
                    if jjj % 2 == 1: sheet.write(row,col, int(x))
                    else: sheet.write(row,col, x)
        else:
            if V: print(' ')
        row += 1

####################
results = dict( (entropyCut,{}) for entropyCut in entropyCuts)

numpermissive_vs_cut = dict( (reflabel,[]) for reflabel in Reference_labels)
for entropyCut in entropyCuts:
    permissive = dict( (reflabel,[]) for reflabel in Reference_labels)
    nonpermissive = dict( (reflabel,[]) for reflabel in Reference_labels)
    example = dict( (reflabel, '') for reflabel in Reference_labels)
    examples = dict( (reflabel, -999) for reflabel in Reference_labels)
    if V: print('NnProcessing, assuming an Entropy cutoff of',entropyCut)
    listedpositioncounter = 0
    for mi in commonpositions:
        if mi in sites_that_match_a_REF:
            aapoplist = sorted(list(nogapaapops[mi].items()), key=lambda x:x[1],reverse=True)
            aareport = ', '.join('%s,%d'% (aa,aapop) for aa,aapop in aapoplist)

listedpositioncounter += 1
            if seqentropy[mi] > entropyCut:

for refi, REF in enumerate(Reference_indices):
                    reflabel = Reference_labels[refi]
                    try:
                        i = A.masterindex2index[REF][mi]
                        permissive[reflabel].append(i)
                        if seqentropy[mi] > examples[reflabel]:
                            examples[reflabel] = seqentropy[mi]
                            exampleREFseq = A.nogapseqs[REF]
                            example[reflabel] = (i, exampleREFseq[i-1], seqentropy[mi], len(aapolist), aareport)
                    except: pass
            else:
                for refi, REF in enumerate (Reference_indices):
                    reflabel = Reference_labels[refi]
                    try:
                        i = A.masterindex2index[REF][mi]
                        nonpermissive[reflabel].append(i)
                    except: pass
    results[entropyCut]['permissive'] = permissive.copy()
    results[entropyCut][ 'nonpermissive'] = nonpermissive.copy()
    for refi, REF in enumerate(Reference_indices):
        reflabel = Reference_labels[refi]
        if V: print('Mapped %d permissive sites to %s residues' % (len(permissive[reflabel]), reflabel))
        if V: print('Mapped %d nonpermissive sites to %s residues' % (len(nonpermissive[reflabel]), reflabel))
        numpermissive_vs_cut[reflabel].append( (len(permissive[reflabel]), entropyCut) )

Print other useful statistics
if V: print (NA, 'alignment positions')

Sites that match more than half of the entries and at least one of the reference sequences will be reported
#numpos = listedpositioncounter
reported_positions = set(commonpositions).intersection(sites_that_match_a_REF)
numpos = len(reported_positions)
if V: print(numpos, 'reported positions aligned to a reference sequence:'. Reference_labels)

for sCut in entropyCuts:
    print('\nNon-permissive sites corresponding to %s with entropy threshold of %.2f:'%(reflabel, sCut))
    print(results[sCut]['nonpermissive'][reflabel])
```

FIGURE 5C

```
import subprocess
import os
translateAA = {'a':'ALA', 'c':'CYS', 'd':'ASP', 'e':'GLU', 'f':'PHE', 'g':'GLY', 'h':'HIS',
               'i':' ILE', 'k':'LYS ', 'l':'LEU', 'm':'MET', 'n':'ASN', 'p':'PRO', 'q':'GLN ',
               'r':'ARG', 's':'SER', 't':'THR', 'v':'VAL', 'w':'TRP', 'y':'TYR'}
translateAA.update( dict((k.upper(),v) for k,v in list(translateAA.items())) )

def getPWID(seqA, seqB):
    tmpfasta = open('test.fasta ','w')
    print( '>A', file=tmpfasta)
    print(seqA, file=tmpfasta)
    print( '>B', file=tmpfasta)
    print(seqB, file=tmpfasta)
    tmpfasta.close()
    if os.path.isfile('test.stats'): os.remove('test.stats')
    cmd = 'clustalw2 test.fasta -stats=test.stats'
    proc = subprocess.Popen(cmd, shell=True, stdout=subprocess.PIPE)
    proc.communicate()

assert os.path.isfile( 'test.stats ')
    for l in open( 'test.stats').readlines():
        if l.startswith('aln pw-id highest:'):
            pwid = float(l.split()[-1])
    os.remove('test.fasta')
    os.remove('test.aln ')
    os.remove('test.dnd ')
    return pwid class Aln:
    def _init_(self, alnfile, headerlen=3, spacerlen=l):
        lines = open(alnfile).readlines()
        self.lines = lines
        print('Read %d lines from %s' % (len(lines), alnfile))
        print('Assuming the file has a header length of %d and a spacer length of %d'%(headerlen,spacerlen))
        ## Figure out how many entries
        counter = 0
        #headercounter = 0
        insideblock = False
        for l in lines:
            if len(l) < 50 or len(l.replace(' ','')) < 50: ## Now out of a sequence block
                if insideblock: ## Was in the block
                    self.N = counter
                    #self.headerlen = headercounter
                    #self.spacerlen = headercounter - 1
                    self.headerlen = headerlen
                    self.spacerlen = spacerlen
                    self.n = int(float(len(lines))/(self.N + self.spacerlen))
                    break
                #else: headercounter += 1
            else:
                insideblock = True
                counter += 1
                #print l.strip(), insideblock, counter, len(l)

print('It looks like %s has %d sequences in %d blocks'%(alnfile,self.N,self.n))

self.data = dict( (j,[]) for j in range(self.N))
        self.labels = {}
```

FIGURE 5D

```
            for i in range(self.n):
                for j in range(self.N):
                    linenum = self.headerlen + i*(self.N+self.spacerlen) + j
                    rawline = lines[linenum]
                    print(i, j, self.N, linenum, rawline)
                    seqblock = rawline.strip().split()[-1].upper()
                    self.labels[j] = rawline.split()[0]
                    self.data[j].append(seqblock)

Create dictionaries containing the full sequences with and without gaps for each entry
            self.label2i = dict( (label,i) for i,label in list(self.labels.items()))
            self.fullseqs = dict( (j, ' '.join(self.data[j])) for j in range(self.N))
            self.nogapseqs = dict( (j, self.fullseqs[j].replace( ) for j in range(self.N))
            self.label2seq = {}
            for i, label in list(self.labels.items()):
                self.label2seq[label] = self.nogapseqs[i]

Create a dictionary that maps the residue ID within each sequence to the position in the MSA
            self.index2masterindex = dict( (j,{}) for j in range(self.N))
            for i in range(self.N):
                fullseq = self.fullseqs[i]
                nogaps = self.nogapseqs[i]
                counter = 0
                for j,x in enumerate(fullseq):
                    if x != '-':
                        counter += 1
                        ## Which position in the alignment (j) does residue counter in sequence i fall?
                        self.index2masterindex[i][counter] = j

Create a dictionary to lookup the Residue ID given the site index within the MSA
            self.masterindex2index = dict( (j,{}) for j in range(self.N))
            for j in range(self.N):
                for i, mi in list(self.index2masterindex[j].items()):
                    self.masterindex2index[j][mi] = i

Determine how many alignment positions there are
            self.NumAliPos = len(self.fullseqs[0])

def PSeqID(self, i,j):
        I = self.fullseqs[i]
        J = self.fullseqs[j]
        ali = list(zip(I,J))
        matchtot = sum(x[0]==x[1] and x[0]!='-' for x in ali)
        nongaptot = sum(x[0]!='-' and x[1]!='-' for x in ali)
        return float(matchtot)/nongaptot def NumCompared(self, i,j):
        I = self.fullseqs[i]
        J = self.fullseqs[j]
        ali = list(zip(I,J))
        nongaptot = sum(x[0]!='-' and x[1]!= 1'-' for x in ali)
        return nongaptot def WriteFasta(self, outfile):
        outfasta = open(outfile,'w')
        for i, label in list(self.labels.items()):
            print( '>' + label, file=outfasta)
            print(self.nogapseqs[i], file=outfasta)
```

FIGURE 5E

SYNTHESIS OF BETA-HYDROXYISOVALERATE AND METHODS OF USE

PRIORITY CLAIM

This application claims the benefit of U.S. Provisional Application No. 63/171,418, filed Apr. 6, 2021, which is hereby incorporated by reference in its entirety.

INCORPORATION-BY-REFERENCE OF SEQUENCE LISTING READ-ONLY FILE

The ASCII plain text file titled "0005_SequenceListing_Txt.txt" created on Apr. 6, 2022 having the size of 737 KB is incorporated by reference in its entirety.

FIELD OF THE INVENTION

The present disclosure generally relates to biological processes of producing beta-hydroxyisovalerate, more particularly methods to create one or more enzymes and uses of the one or more enzymes to produce beta-hydroxyisovalerate, and even more specifically to non-natural enzymes that produce beta-hydroxyisovalerate.

BACKGROUND

The beta-hydroxyisovalerate (βHIV) molecule (shown below), which is also known as 3-hydroxy-3-methylbutric acid, has potential applications ranging from liquid crystals to pharmaceutical ingredients and dietary supplements.

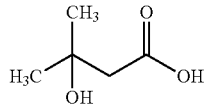

As such, a number of methods to produce βHIV are known in the art. They are mainly centered around chemical, organic synthesis starting with 4-hydroxy-4-methyl-2-pentanone. βHIV can be synthesized by the oxidation of 4-hydroxy-4-methyl-2-pentanone. One suitable procedure is described by Coffman et al., J. Am. Chem. Soc. 80:2882-2887 (1958). See also, for example, US6248922, US6090978 US1016471653, US6090918 and US2014025698. As described therein, βHIV is synthesized by an alkaline sodium hypochlorite oxidation of diacetone alcohol. The product is recovered in free acid form, which can be converted to a salt. For example, βHIV can be prepared as its calcium salt by a procedure similar to that of Coffman et al. (1958) in which the free acid of βHIV is neutralized with calcium hydroxide and recovered by crystallization from an aqueous ethanol solution.

Biological methods to produce βHIV are also known. For example, βHIV can also be prepared by the conversion of 3-methylcrotonate (3-methylbut-2-enoate) by cell-free extracts of Galactomyces reessii [Dhar and JPN Rosazza. Journal of Industrial Microbiology & Biotechnology 2002, 28, 81-87]. Cell free extracts of Galactomyces reessii contain an enoyl CoA hydratase that can catalyze the transformation of 3-methylcrotonic acid to βHIV. Resting cells of Galactomyces reessii could convert β-methylbutyrate into β-hydroxyisovalerate [Lee I Y, Nissen S L, Rosazza J P. Applied and environmental microbiology 1997, 63 (11): 4191-4195; Lee I Y, Rosazza J P. Arch. Microbiol., 1998 March; 169 (3): 257-62]. Using a two-step fed-batch fermentation process where biomass was first produced to sufficient density in the first step, followed by the addition of β-methylbutyrate to the washed biomass in the second step, Lee et al. reported producing 38 g/L of βHIV. The availability of 3-methylcrotonic acid or β-methylbutyrate in economically viable quantities for in vitro or in vivo production of βHIV is still a challenge that needs to be overcome before this process can become commercially viable.

Indeed, βHIV is synthesized in humans through the metabolism of L-leucine (see for example Nutrient Metabolism, Martin Kohlmeier, Academic Press, 2015) as a result of the conversion of its keto acid, α-ketoisocaproate (KIC) by the promiscuous action of 4-hydroxyphenylpyruvate dioxygenase (HPPD). Dioxygenases are enzymes that incorporate diatomic oxygen to form oxo-intermediates. To reduce diatomic oxygen, these enzymes require a source of electrons as well as a cofactor capable of one-electron chemistry. The ferrous ion is the most common cofactor capable of localizing substrates by acting as a conduit to transfer the electrons from the substrates to oxygen. Common coordinated reductant for the ferrous ion is the α-keto acid moiety and α-keto acid dependent oxygenases are very versatile and play a key role in the secondary metabolism [Purpero and Moran, J. Biol. Inorg. Chem. 12 (2007) 587-601].

A majority of the α-keto acid dependent oxygenases have three substrates—oxygen, α-ketoglutarate (the source of the α-keto acid) and the substrate, whose transformation is the catalytic objective [Hausinger, Crit. Rev. Biochem. Mol. Biol. 39 (2004) 21-68]. HPPD and hydroxymandelate synthase (HMS) are an exception to this general principal by having only two substrates. HPPD and HMS receive electrons from their common α-keto acid substrate, 4-hydroxyphenylpyruvate (HPP), and also transform it into their hydroxylated and decarboxylated products homogentisate and hydroxymandelate, respectively, without the need for α-ketoglutarate. These two enzymes are believed to have evolved from an entirely different lineage than all other α-keto acid oxygenases [Moran, G. M., Archives of Biochemistry and Biophysics 544 (2014) 58-68] although their core catalytic mechanism is consistent with the enzyme family.

There is a large body of literature on HPPD, owing to its importance in agriculture and medicine. The primary product of HPPD reaction is homogentisate, which is the precursor to plastoquinone and tocopherols in plants and archaea. They are intimately involved in electron transport in the photosynthetic system, serve as antioxidants and plant hormones. Therefore, inhibiting the synthesis of homogentisate is commonly used to inhibit the growth of plants and weeds. A number of molecules such as leptospermone and usnic acid and their similars inhibit HPPD activity and are used as ingredients in herbicides [Beaudegnies et al., Bioorg. Med. Chem. 17 (2009) 4134-4152]. HPPD inhibitors such as NTBC (nitisinone) is used to treat Type 1 tyrosinemia. Inborn genetic errors leading to aberrant metabolic enzymes in the catabolism of homogentisate causes Type 1 tyrosinemia. NTBC has been used as a treatment by repressing the synthesis of homogentisate by inhibiting HPPD [Lindstedt et al., Lancet 340 (1992) 813-817].

Interestingly, HPPD was also shown to produce βHIV as a result of its promiscuity towards α-ketoisocaproate, the keto acid of leucine [Crouch N P, E. Baldwin, M.-H. Lee, C. H. Mackinnon, Z. H. Zhang, Bioorg Med Chem Lett 1996, 6 (13): 1503-1506]. In addition to its involvement in aromatic amino acid metabolism, HPPD is involved in the metabolism of leucine by converting excess α-ketoisocaproate into βHIV [Crouch N P, Lee M H, Iturriagagoitia-Bueno T, Mackinnon C H. Methods in enzymology 2000, 324:342-355]. Prior to the elucidation of the promiscuity of HPPD, a dedicated dioxygenase to transform α-ketoisocaproate into βHIV was alleged to exist [Sabourin P J, Bieber L L: The Journal of biological chemistry 1982, 257 (13): 7468-7471; Sabourin P J, Bieber L L: Methods in enzymology 1988, 166:288-297; Sabourin P J, Bieber L L: Metabolism: clinical and experimental 1983, 32 (2): 160-164; Xu et al., Biochemical and Biophysical Research Communications 276, (2000), 1080-1084]. Baldwin et al., (1995) published early reports of HPPD having several fold higher activity with HPP than with α-ketoisocaproate [Baldwin et al., Bioorganic and Medicinal Chemistry Letters, 5 (12) (1995), 1255-1260]. Subsequently, sequence studies and further biochemical analyses by Crouch et al, (1996) and Crouch et al., (2000) confirmed that the alleged dioxygenase was HPPD which catalyzed the conversion of α-ketoisocaproate into βHIV as a result of its promiscuity. Indeed, Crouch et al., 1996 suggested any further reference to HPPD as α-ketoisocaproate dioxygenase be discontinued. The promiscuity of HPPD is also evident by its transformation of 2-keto-4-(methylthio) butyric acid, the keto acid of methionine [Adlington, R. M., et al., Bioorganic & Medicinal Chemistry Letters, Volume 6, Issue 16, 20 Aug. 1996, 2003-2006].

Unlike some enzymes where substrate specificity is dictated only by active site conformation, the substrate specificity in HPPD extends beyond its active site pocket. The active site of HPPD is enclosed by a C-terminal a-helix which is believed to function as a gate-keeper for substrate access (Fritze et al., Plant Physiol. Vol. 134, 2004). The rat HPPD was completely inactive when 14 residues were deleted from the C-terminus [Lee et al., FEBS Letters, Vol. 393, Issues 2-3, 1996, 269-272]. Similarly, the human enzyme was inactive when 15 residues of the C-terminus were deleted [Lin et al., PLOS ONE 8 (8): e69733, 2013]. Other roles for the C-terminus are also possible. For example, homology modeling for a closed conformation for rat HPPD suggests that Q375 forms bifurcate hydrogen bonds with N380 and S250 while D384 may form a salt bridge pair with K249 in SEQ ID NO: 1. Therefore, the dynamic interactions of these sites (and others) might mediate the position of the C-terminal helix to ensure that the gate is opened during the catalytic cycle to allow binding of KIC and releasing HMB. These interactions may be necessary to maintain the integrity of the active site and ensure correct substrate orientation. Not only the presence of an intact C-terminal helix is critical, but its conformation also appears to play a significant role in substrate specificity.

Given that βHIV is produced using chemical processes that are not only energy-intensive, but also result in toxic by-products, there is a clear and urgent need to develop environmentally benign processes that use renewable feedstocks. There is also a need for the production of high quality βHIV that is cost-effective and efficiently produced.

SUMMARY

The subject of the present disclosure satisfies the need and provides related advantages as well. Provided herein are certain embodiments to create non-natural enzymes with increased catalytic activity to produce βHIV. Also provided herein are certain embodiments of using non-natural enzymes in microorganisms as well as in a cell-free environment to produce βHIV.

Provided herein are methods to engineer naturally occurring polypeptides for improved conversion of α-ketoisocaproate into βHIV and uses of the engineered, non-natural enzymes. This disclosure also provides microorganisms that can host the engineered enzymes for the synthesis of βHIV.

In some embodiments, the parent enzymes with basal βHIV synthase activity are polypeptides that are at least 65% identical to a polypeptide selected from SEQ ID NOs: 1-3. In certain embodiments, the polypeptide with βHIV synthase activity is derived from *Rattus norvegicus*. In some embodiments, the parent enzymes with βHIV synthase are polypeptides that are at least 65% identical to a polypeptide selected from SEQ ID NOs: 4-148.

In some embodiments, naturally occurring enzymes with basal βHIV synthase activity are modified or mutated to increase their ability to catalyze α-ketoisocaproate into βHIV. Examples of such non-natural enzymes with increased βHIV activity compared with their corresponding wild-type parent are those having one or more modifications or mutations at positions corresponding to amino acids selected from A361, F336, F347, F364, F368, F371, G362, I227, I252, L224, L289, L323, L367, N187, N241, N363, P239, Q251, Q265, S226, V212, V217, V228 and W210 of SEQ ID NO: 1.

In some embodiments, the non-natural enzymes with βHIV synthase activity have at least one or more of the following modifications or mutations: leucine, isoleucine or methionine at position 361 of SEQ ID NO: 1, leucine, isoleucine, methionine or tryptophan at position 336 of SEQ ID NO: 1, tryptophan, tyrosine or isoleucine at position 347 of SEQ ID NO: 1, alanine, leucine, isoleucine, methionine or tryptophan at position 364 of SEQ ID NO: 1, tyrosine, tryptophan, leucine, isoleucine or methionine at position 368 of SEQ ID NO: 1, leucine, isoleucine or methionine at position 371 of SEQ ID NO: 1, leucine, isoleucine or methionine at position 362 of SEQ ID NO: 1, leucine, valine or methionine at position 227 of SEQ ID NO: 1, leucine, valine or methionine at position 252 of SEQ ID NO: 1, phenylalanine, tryptophan or methionine at position 224 of SEQ ID NO: 1, leucine, valine or methionine at position 289 of SEQ ID NO: 1, tryptophan, tyrosine or isoleucine at position 323 of SEQ ID NO: 1, leucine, isoleucine, tryptophan or methionine at position 367 of SEQ ID NO: 1, phenylalanine, tryptophan or methionine at position 187 of SEQ ID NO: 1, phenylalanine, tryptophan or methionine at position 241 of SEQ ID NO: 1, isoleucine, methionine or valine at position 363 of SEQ ID NO: 1, leucine at position 239 of SEQ ID NO: 1, methionine, isoleucine or proline at position 251 of SEQ ID NO: 1, methionine, isoleucine or proline at position 265 of SEQ ID NO: 1, valine, methionine, isoleucine or leucine at position 226 of SEQ ID NO: 1, phenylalanine, leucine, isoleucine or tryptophan at position 212 of SEQ ID NO: 1, isoleucine, leucine or methionine at position 217, isoleucine, leucine or methionine at position 228 of SEQ ID NO: 1, and/or leucine at position 210 of SEQ ID NO: 1.

In some embodiments, at least one nucleic acid encoding a polypeptide with βHIV synthase activity is introduced into a microorganism, wherein said polypeptide is at least about 65% identical to a polypeptide selected from SEQ ID NOs: 1-3.

In some embodiments, at least one nucleic acid encoding a polypeptide with βHIV synthase activity is introduced into a microorganism, wherein said polypeptide comprises at least one or more of the modifications or mutations mentioned above. In some embodiments, the non-natural microorganism produces βHIV, and in some aspects produces more βHIV than its unmodified parent.

In some embodiments, the non-natural microorganism comprising βHIV synthase activity comprises a pathway consisting of (i) pyruvate to acetolactate, (ii) acetolactate to 2,3-dihydroxyisovalerate, (iii) 2,3-dihydroxyisovalerate to α-ketoisovalerate, (iv) α-ketoisovalerate to α-isopropylmalate, (v) α-isopropylmalate to β-isopropylmalate, (vi) β-isopropylmalate to α-ketoisocaproate and (vii) α-ketoisocaproate to βHIV. In one embodiment, one or more genes for the pathway comprising of steps (i) to (vii) encodes an enzyme that is localized to the cytosol.

In some embodiments, a non-natural microorganism comprises a metabolic pathway relating to one or more steps of (i) pyruvate into acetolactate, (ii) acetolactate into 2,3-dihydroxyisovalerate, (iii) 2,3-dihydroxyisovalerate into α-ketoisovalerate, (iv) α-ketoisovalerate into 2-isopropylmalate, (v) 2-isopropylmalate into 2-isopropylmaleate, (vi) 2-isopropylmaleate into 3-isopropylmalate, (vii) 3-isopropylmalate into 2-isopropyl-3-oxosuccinate, (viii) 2-isopropyl-3-oxosuccinate into α-ketoisocaproate, and (ix) α-ketoisocaproate into βHIV. In some aspects, one or more genes for the one or more steps (i) to (ix) of the metabolic pathway encodes an enzyme that is localized to the cytosol.

In certain embodiments, the non-natural microorganisms comprise a βHIV producing metabolic pathway with at least one βHIV pathway enzyme localized in the cytosol. In an exemplary embodiment, the non-natural microorganisms comprise a βHIV producing metabolic pathway with all the βHIV pathway enzymes localized in the cytosol.

In certain embodiments, the non-natural microorganism expresses or overexpresses at least one of the genes encoding for acetolactate synthase (EC: 2.2.1.6), keto-acid reductoisomerase (EC: 1.1.1.86), dihydroxyacid dehydratase (EC: 4.2.1.9), 2-isopropylmalate synthase (EC: 2.3.3.13), isopropylmalate isomerase (EC: 4.2.1.33), 3-isopropylmalate dehydrogenase (EC: 1.1.1.85) and βHIV synthase. In some aspects, the non-natural microorganism expresses or overexpresses two or more genes encoding for acetolactate synthase, keto-acid reductoisomerase, dihydroxyacid dehydratase, 2-isopropylmalate synthase, isopropylmalate isomerase, 3-isopropylmalate dehydrogenase and/or βHIV synthase. In preferred embodiments, these enzymes are localized in the cytosol.

In certain embodiments, the non-natural microorganisms may be prokaryotic microorganisms. In some embodiments, the prokaryotic microorganisms may be Gram-positive selected from the group comprising of *Corynebacterium, Lactobacillus, Lactococcus* and *Bacillus*. In some embodiments, the non-natural prokaryotic microorganisms may be Gram-negative selected from the group comprising of *Escherichia* and *Pseudomonas*. In another embodiment, the non-natural microorganism may be non-natural eukaryotic microorganisms. In certain embodiments, the non-natural eukaryotic microorganisms may be non-natural yeast microorganisms. In some embodiments, the non-natural yeast may be Crabtree-negative yeasts. In some embodiments, the non-natural yeast microorganism may be selected from the group consisting of *Saccharomyces, Kluyveromyces, Pichia, Issatchenkia, Hansenula,* or *Candida*.

In another embodiment, the non-natural microorganism may be cultivated in a culture medium containing a feedstock providing the carbon source until a recoverable quantity of βHIV is produced and optionally recovering the βHIV. In certain embodiments, the non-natural microorganism produces βHIV from a carbon source with a yield of at least about 0.1 percent of theoretical yield. In another aspect, the non-natural microorganism produces βHIV from a carbon source with a yield of at least about 1 percent of theoretical yield. In another aspect, the non-natural microorganism produces βHIV from a carbon source with a yield of at least about 5 percent of theoretical yield. In another aspect, the non-natural microorganism produces βHIV from a carbon source with a yield of at least 20 percent of theoretical yield. In another aspect, the non-natural microorganism produces βHIV from a carbon source with a yield of at least 50 percent, at least about 75 percent, at least about 80 percent, or at least about 85 percent of the theoretical yield.

In some aspects, the non-natural microorganism produces βHIV from a carbon source with a yield of at least about 0.1 percent up to 100 percent of theoretical yield, in some aspects at least about 1 percent up to 99.9 percent of theoretical yield, in some aspects at least about 5 percent up to about 99.5 of theoretical yield, in some aspects at least 20 percent up to about 99.5 percent of theoretical yield, in some aspects at least 50 percent up to about 99.5 percent of theoretical yield, in some aspects at least about 75 percent up to about 99.5 percent of theoretical yield, in some aspects at least about 80 percent up to about 99.5 percent of theoretical yield, and in some aspects at least about 85 percent up to about 99.5 percent of theoretical yield.

In some embodiments, the non-natural polypeptide comprising βHIV synthase activity may enable the "in vitro" conversion of α-ketoisocaproate into βHIV in the presence of co-substrates and co-factors.

In some embodiments, a method of producing βHIV using a non-natural enzyme expressed in a microorganism comprises providing a non-natural enzyme expressed in a microorganism, the non-natural enzyme comprising one or more amino acid modifications relative to a wild-type parent enzyme, wherein the non-natural enzyme is modified to provide more beta-hydroxyisovalerate synthase activity than the wild-type parent, cultivating the microorganism in a culture containing a feedstock of a carbon source until a recoverable quantity of βHIV is produced, and recovering the recoverable quantity of produced βHIV.

In some aspects, the method of producing βHIV using a non-natural enzyme expressed in a microorganism further comprises purifying the recoverable quantity of βHIV.

In some embodiments, the present invention is directed to a composition comprising βHIV produced by a non-natural enzyme, wherein the βHIV prior to any isolation or purification process has not been in substantial contact with any component comprising a halogen-containing component. In some aspects, the halogen-containing component is a chemical derivative produced by a typical chemical production process of βHIV. In some aspects, the halogen-containing component comprises hydrochloric acid and/or chloroform.

The above summary is not intended to describe each illustrated embodiment or every implementation of the subject matter hereof. The figures and the detailed description that follow more particularly exemplify various embodiments.

BRIEF DESCRIPTION OF THE FIGURES

Subject matter hereof may be more completely understood in consideration of the following detailed description of various embodiments in connection with the accompanying figures, in which:

FIG. 5A-5E illustrates Python scripts used to calculate sequence entropy within dioxygenases described herein, according to certain embodiments of the present invention.

Figure 1:
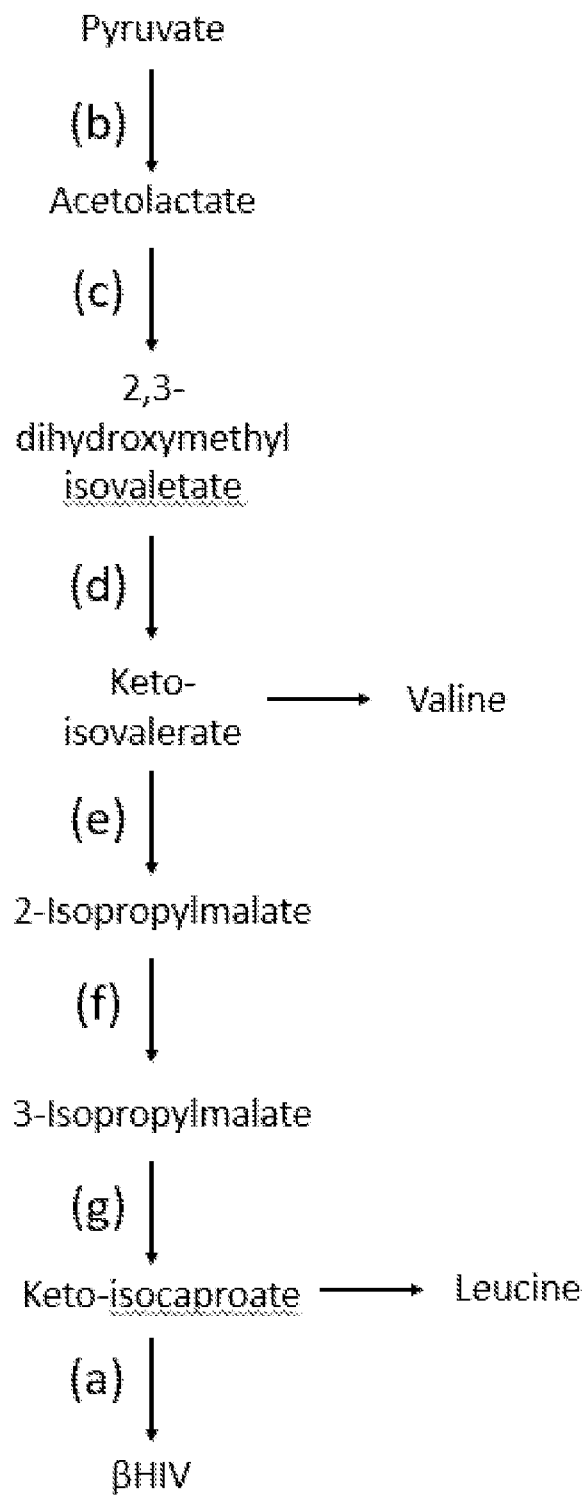
FIG. 1 illustrates a βHIV metabolic pathway, according to certain embodiments of the present invention. According to some aspects of this disclosure, the metabolic pathway can also comprise an active transporter to transport βHIV out of the non-natural microorganism.

While various embodiments are amenable to various modifications and alternative forms, specifics thereof have been shown by way of example in the drawings and will be described in detail. It should be understood, however, that the intention is not to limit the claimed inventions to the particular embodiments described. On the contrary, the intention is to cover all modifications, equivalents, and alternatives falling within the spirit and scope of the subject matter as defined by the claims.

DETAILED DESCRIPTION OF THE INVENTION

The following description of the present disclosure is merely intended to illustrate various embodiments. As such, the specific modifications discussed are not to be construed as limitations on the scope of the present disclosure. It will be apparent to one skilled in the art that various equivalents, changes, and modifications may be made without departing from the scope of the present disclosure, and it is understood that such equivalent embodiments are to be included herein. All references cited herein are incorporated by reference in their entirety.

The present disclosure relates to non-natural enzymes with beta hydroxyisovalerate synthase activity and the uses of said enzymes to produce higher value products such as beta hydroxyisovalerate (βHIV). More specifically, the present disclosure relates to engineered enzymes that have higher βHIV synthase activity than their parent wildtype. As a molecule with unique structure, βHIV has potential applications ranging from liquid crystals to pharmaceutical ingredients and dietary supplements.

As used herein, "β-hydroxyisovalerate" or "beta hydroxyisovalerate" or "βHIV" or "β-hydroxy-β-methylbutyrate" or "3-hydroxy-3-methylbutyric acid" refer to the same compound having the following molecular structures (free acid form on left and conjugate base on the right).

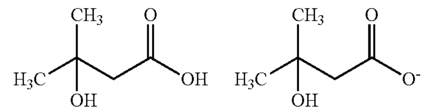

Furthermore, these terms not only include the free acid form or conjugate base, but also the salt form with a cation and derivatives thereof, or any combination of these compounds. For instance, a calcium salt of βHIV includes calcium βHIV hydrate having the following molecular structure.

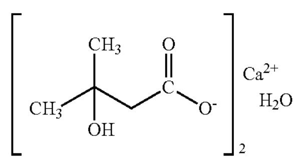

While the foregoing terms mean any form of βHIV, the form of βHIV used within the context of the present disclosure preferably is selected from the group comprising of a free acid, a calcium salt, an ester and a lactone.

As used herein, the term "gene" refers to a nucleic acid sequence that can be transcribed into messenger RNA and further translated into protein.

The term "nucleic acid" as used herein, includes reference to a deoxyribonucleotide or ribonucleotide polymer, i.e. a polynucleotide, in either single- or double-stranded form, and unless otherwise limited, encompasses known analogues having the essential nature of natural nucleotides in that they hybridize to single-stranded nucleic acids in a manner similar to naturally occurring nucleotides (e.g., peptide nucleic acids). A polynucleotide can be full-length or a subsequence of a native or heterologous structural or regulatory gene. Unless otherwise indicated, the term includes reference to the specified sequence as well as the complementary sequence thereof.

Usually, the nucleotide sequence encoding an enzyme is operably linked to a promoter that causes sufficient expression of the corresponding nucleotide sequence in the host microorganism according to the present disclosure to confer to the cell the ability to produce β-hydroxyisovaleric acid. As used herein, the term "operably linked" refers to a linkage of polynucleotide elements (or coding sequences or nucleic acid sequence) in a functional relationship. A nucleic acid sequence is "operably linked" when it is placed into a functional relationship with another nucleic acid sequence. For instance, a promoter or enhancer is operably linked to a coding sequence if it affects the transcription of the coding sequence. In order to increase the likelihood that an exogenous gene is translated into an enzyme that is in active form, the corresponding nucleotide sequence may be adapted to optimize its codon usage to that of the chosen host microorganism. Several methods for codon optimization are known in the art and are embedded in computer programs such as CodonW, GenSmart, CodonOpt, etc.

As used herein, the term "promoter" refers to a nucleic acid fragment that functions to control the transcription of one or more genes, located upstream with respect to the direction of transcription of the transcription initiation site of the gene, and is structurally identified by the presence of a binding site for a nucleic acid polymerase, transcription initiation sites and any other DNA sequences known to one of skill in the art. A "constitutive" promoter is a promoter that is active under most environmental and developmental conditions. An "inducible" promoter is a promoter that is active under environmental or developmental regulation.

The terms "polypeptide", "peptide" and "protein" are used interchangeably herein to refer to a polymer of amino acid residues. The terms apply to amino acid polymers in which one or more amino acid residue is an artificial chemical analogue of a corresponding naturally occurring amino acid, as well as to naturally occurring amino acid polymers. The essential nature of such analogues of naturally occurring amino acids is that, when incorporated into a protein, the protein is specifically reactive to antibodies elicited to the same protein but consisting entirely of naturally occurring amino acids. The terms "polypeptide", "peptide" and "protein" are also inclusive of modifications including, but not limited to, glycosylation, lipid attachment, sulfation, gamma-carboxylation of glutamic acid residues, hydroxylation and ADP-ribosylation.

The term "enzyme" as used herein is defined as a protein which catalyzes a (bio) chemical reaction in a cell. The interaction of an enzyme with other molecules such as the substrate can be quantified by the Michaelis constant ($K_M$), which indicates the affinity of the substrate to the active site of the enzyme. $K_M$ can be quantified using prior art (see for example, Stryer, Biochemistry, 4th edition, W. H. Freeman, Nelson and Cox, Lenhinger Principles of Biochemistry, 6th edition, W. H. Freeman). The rate of biocatalysis or enzymatic activity is defined by $k_{cat}$, which is the enzyme turnover number. Therefore, the ratio of the rate of enzymatic activity to the substrate affinity is widely considered to be representative of an enzyme's catalytic efficiency. As defined herein, the efficiency of an enzyme to act on a specific substrate is quantified by the ratio of $k_{cat}/K_M$. Therefore, an enzyme with higher value of $k_{cat}/K_M$ for a certain substrate can catalyze the reaction more efficiently than another enzyme with a lower value of $k_{cat}/K_M$ for the same substrate.

As used herein, β-hydroxyisovalerate synthase refers to an enzyme that can catalyze the conversion of α-ketoisocaproate into βHIV. One Unit (U) of βHIV synthase activity is defined herein as the amount of enzyme needed to convert one micromole of α-ketoisocaproate into βHIV in one minute under the reaction conditions. Accordingly, a variant of βHIV synthase that can convert more α-ketoisocaproate into βHIV than the same amount of another variant is preferred.

Figure 2:
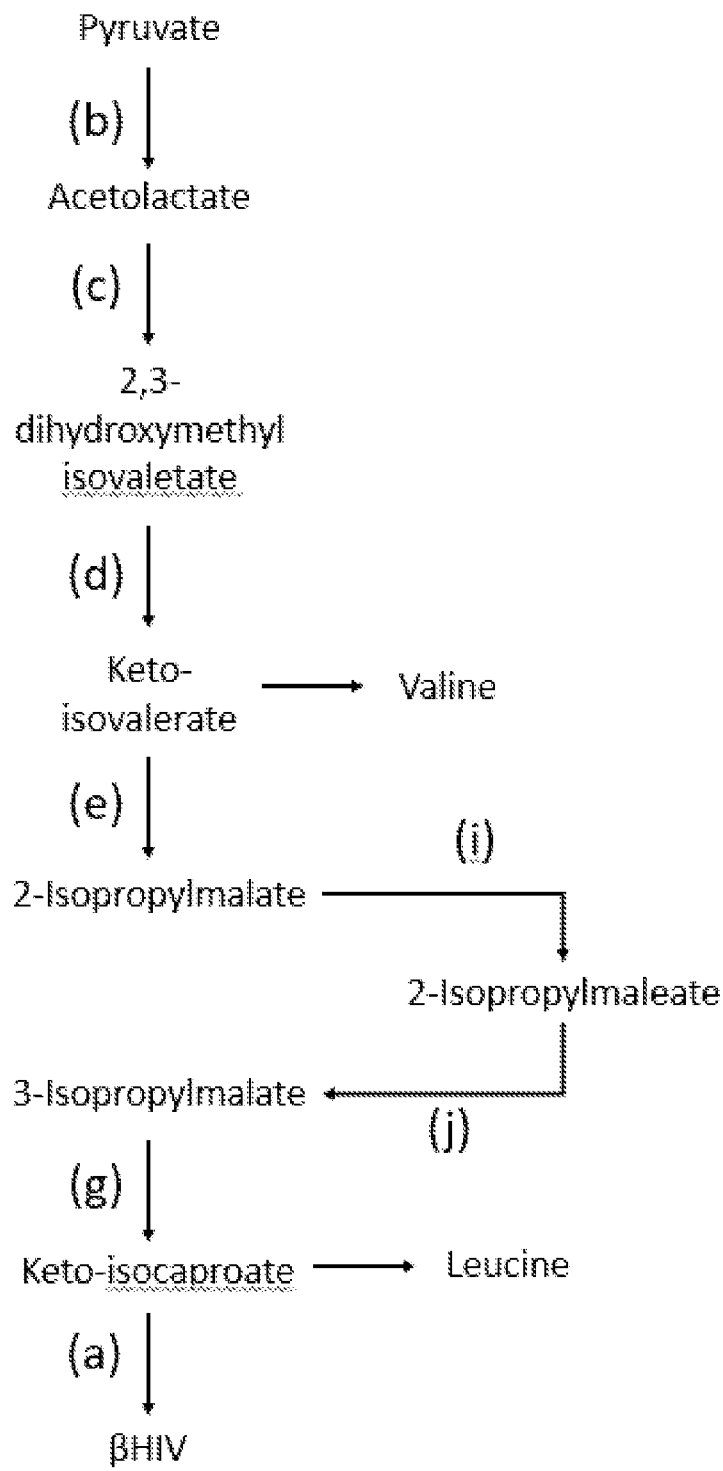
FIG. 2 illustrates another βHIV metabolic pathway, according to certain embodiments of the present invention. According to some aspects of this disclosure, the metabolic pathway can also comprise an active transporter to transport βHIV out of the non-natural microorganism.

The term "biosynthetic pathway", also referred to as "metabolic pathway", refers to a set of anabolic or catabolic biochemical reactions for converting one chemical species into another. Gene products belong to the same "metabolic pathway" if they, in parallel or in series, act on the same substrate, produce the same product, or act on or produce a metabolic intermediate (i.e., metabolite) between the same substrate and metabolite end product. As used herein, the term "βHIV metabolic pathway" refers to an enzyme pathway which produces βHIV from pyruvate, as illustrated in FIG. 1 or FIG. 2.

As used herein, the term "microorganism" refers to a prokaryote such as a bacterium or a eukaryote such as a yeast. As used herein, the term "non-natural microorganism" refers to a microorganism that has at least one genetic alteration not normally found in a naturally occurring strain of the species, including wild-type strains of the reference species. Genetic alterations include, for example, human-intervened modifications introducing expressible nucleic acids encoding polypeptides, other nucleic acid additions, nucleic acid deletions and/or other functional disruption of the microorganism's genetic material. When a microorganism is genetically engineered to overexpress a given enzyme, it is manipulated such that the host cell has the capability to express, and preferably, overexpress an enzyme, thereby increasing the biocatalytic capability of the cell. When a microorganism is engineered to inactivate a gene, it is manipulated such that the host cell has decreased, and preferably, lost the capability to express an enzyme. As used herein, the term "overexpress" refers to increasing the expression of an enzyme to a level greater than the cell normally produces. The term encompasses overexpression of endogenous as well as exogenous enzymes. As used herein, the terms "gene deletion" or "gene knockout" or "gene disruption" refer to the targeted disruption of the gene in vivo resulting in the removal of one or more nucleotides from the genome resulting in decreased or loss of function using genetic manipulation methods such as homologous recombination, directed mutagenesis or directed evolution.

HPPD is found in all aerobic forms of life (Gunsior et al, Biochemistry 43, 2004, 663-674). HPPD has been shown to have reasonably broad substrate specificity, recognizing a range of polar and non-polar α-keto acids as substrates. For example, rat HPPD can decarboxylase and oxygenate KIC into βHIV and α-keto-5-thiahexanoic acid into 4-thiapentanoic acid-4-oxide (Baldwin et al., Bioorg. Med. Chem. Lett. 5, 1995, 1255-1260; Adlington et al., Bioorg. Med. Chem. Lett. 6, 1996, 2003-2006). However, HPPD from *Streptomyces* has been shown to be entirely devoid of either decarboxylase or dioxygenase activity in the presence of KIC (Johnson-Winters, Biochemistry, 2003, 42:2072-2080). Therefore, not all HPPDs have the catalytic ability to convert KIC into βHIV. This disclosure relates to identifying HPPDs that have the basal promiscuous activity to produce βHIV.

Several HPPD crystal structures from different organisms have been resolved and are available in the Protein Data Bank (PDB, www.rcsb.org). HPPD is observed to form oligomers. The monomer is folded into structural domains that are arranged as an N-terminal and C-terminal open β-barrel of eight β-strands each. The active site is located inside the β-barrel of the C-terminal domain and contains a 2-His-1-carboxylate motif that non-covalently binds a $Fe^{2+}$ ion (Fritze et al., 2004, Plant Physiol 134:1388-1400). An examination of 19 crystal structures (17 HPPDs from rat, human, bacterial, and plant and 2 bacterial hydroxymandelate synthases) in the PDB revealed two conformations for HPPD—an "open" and a "closed". The C-terminal helix forms a "lid" at the active site, with the N-terminal portion of the C-terminal helix in close proximity to the catalytic iron site. It is possible that the C-terminal helix serves as a gatekeeper for substrate docking and/or product release. It is also possible that C-terminal helix structure changes in response to substrate docking and could be allosterically coupled to enzyme catalysis. Given the position and the apparent dynamic structure of the C-terminal helix, it is likely to play a critical role in substrate specificity. Lability of the C-terminal helix may also be related to the ability of these enzymes to catalyze reactions with multiple substrates ("enzyme promiscuity"). Presumably, another source of enzyme promiscuity is the capacity of the catalytic iron to activate molecule oxygen without strict requirements as to the chemical identity of the distal portion of the keto acid substrate.

The naturally occurring parent enzymes identified herein have low activity using α-ketoisocaproate, thereby not enabling efficient production of βHIV. The present disclosure describes methods of increasing βHIV production through the use of non-natural enzymes. Accordingly, the present disclosure is directed to an isolated nucleic acid encoding a polypeptide with βHIV synthase activity, wherein the polypeptide sequence is at least 65% identical to at least one polypeptide selected from SEQ ID Nos: 1-148. Methods to determine identity and similarity are codified in publicly available computer programs. Example computer program methods to determine identity and similarity between two sequences include BLASTP and BLASTN, publicly available from NCBI and other sources (BLAST Manual, Altschul, S., et al., NCBI NLM NIH Bethesda, Md. 20894). Example parameters for amino acid sequences comparison using BLASTP are gap open 11.0, gap extend 1, Blosum 62 matrix.

In certain embodiments, the polypeptide with βHIV synthase activity is derived from the genus *Rattus*. In an example embodiment, the polypeptide with βHIV synthase is derived from *Rattus norvegicus*, F alloantigen *Rattus norvegicus*, *Rattus rattus* or *Rattus losea*. In another example embodiment, the polypeptide with βHIV synthase is selected from at least one of SEQ ID NOS: 1-3.

In some embodiments, the polypeptide with βHIV synthase activity has at least 65% identity to at least one polypeptide selected from SEQ ID NOS: 1-148. Further within the scope of the present application are polypeptides with βHIV synthase activity which are at least about 65%, 70%, 75%, 80%, 85%, 90%, 91%, 92%, 93%, 94%, 95%, 98%, 97%, 98%, 99%, or 99.5% identical to at least one polypeptide selected from SEQ ID NOS: 1-148.

The promiscuous activity of HPPD with α-ketoisocaproate is indicative of a basal level recognition of the desired substrate and the present disclosure discloses methods to increase α-ketoisocaproate activity relative to 4-hydroxyphenyl pyruvate activity (KIC/HPP) by modifying certain amino acids at specific positions in the sequence. Modifying amino acids that play a role in the catalysis can lead to alterations in the enzyme activity. One skilled in the art can recognize the position of these amino acids in homologous protein sequences by aligning the sequences. Two sequences are said to be "optimally aligned" when they are aligned for similarity scoring using a defined amino acid substitution matrix (e.g., BLOSUM62), gap existence penalty and gap extension penalty so as to arrive at the highest score possible for that pair of sequences. Amino acid substitution matrices and their use in quantifying the similarity between two sequences are well-known in the art. The BLOSUM82 matrix is often used as a default scoring substitution matrix in sequence alignment protocols such as Gapped BLAST 2.0. The gap existence penalty is imposed for the introduction of a single amino acid gap in one of the aligned sequences, and the gap extension penalty is imposed for each additional empty amino acid position inserted into an already opened gap. The alignment is defined by the amino acids positions of each sequence at which the alignment begins and ends, and optionally by the insertion of a gap or multiple gaps in one or both sequences, so as to arrive at the highest possible score. While optimal alignment and scoring can be accomplished manually, the process is facilitated by the use of a computer-implemented alignment algorithm, e.g., gapped BLAST 2.0, described in Altschul et al, (1997) Nucleic Acids Res. 25:3389-3402, and made available to the public at the National Center for Biotechnology Information Website. Optimal alignments, including multiple alignments, can be prepared using, e.g., PSI-BLAST with no compositional adjustments.

As described herein, the present inventors identified polypeptides with βHIV synthase activity. One desirable feature of a polypeptide with βHIV synthase activity is the ability to exhibit high activity for the conversion of α-ketoisocaproate into βHIV. Another desirable property of a polypeptide with HIV synthase activity is low activity with the native substrate, HPP, thereby reducing the impact on other substrates. The present disclosure identifies several beneficial modifications or mutations which can be made to an existing dioxygenase enzyme to improve the dioxygenase enzyme's ability to catalyze the conversion of KIC to βHIV with higher activity. In some embodiments, the non-natural enzyme is a polypeptide with increased KIC/HPP activity, wherein the sequence of the polypeptide has at least one modification.

According to certain aspects of the present invention, the non-natural enzyme comprises one or more modifications at substrate-specificity positions corresponding to amino acids selected from A361, F336, F347, F364, F368, F371, G362, I227, I252, L224, L289, L323, L367, N187, N241, N363, P239, Q251, Q265, S226, V212, V217, V228 and W210 of SEQ ID NO: 1.

According to certain aspects of the present invention, the non-natural enzyme comprises one or more modifications at substrate-specificity positions corresponding to amino acids selected from A361, F336, F347, F364, F368, F371, G362, I227, I252, L224, L289, L323, L367, N187, N241, N363, P239, Q251, Q265, S226, V212, V217, V228 and W210 of SEQ ID NO: 6.

In some embodiments, the dioxygenase enzyme has been modified or mutated to alter one or more one of the substrate-specificity residues. In certain embodiments, the dioxygenase enzyme is modified, wherein the residue corresponding to position 361 of SEQ ID NO: 1 is replaced with a residue selected from methionine, leucine and isoleucine. In another embodiment, the dioxygenase enzyme is modified, wherein the residue corresponding to position 336 of SEQ ID NO: 1 is replaced with leucine, methionine, isoleucine and tryptophan. In another embodiment, the dioxygenase enzyme is modified, wherein the residue corresponding to position 347 of SEQ ID NO: 1 is replaced with tryptophan, tyrosine and isoleucine. In another embodiment, the dioxygenase enzyme is modified, wherein the residue corresponding to position 364 of SEQ ID NO: 1 is replaced with methionine, alanine, isoleucine, leucine and tryptophan. In another embodiment, the dioxygenase enzyme is modified, wherein the residue corresponding to position 368 of SEQ ID NO: 1 is replaced with tyrosine, tryptophan, leucine, isoleucine and methionine. In another embodiment, the dioxygenase enzyme is modified, wherein the residue corresponding to position 371 of SEQ ID NO: 1 is replaced with methionine, leucine and isoleucine. In another embodiment, the dioxygenase enzyme is modified, wherein the residue corresponding to position 362 of SEQ ID NO: 1 is replaced with methionine, leucine and isoleucine. In another embodiment, the dioxygenase enzyme is modified, wherein the residue corresponding to position 227 of SEQ ID NO: 1 is replaced with methionine, leucine and isoleucine. In another embodiment, the dioxygenase enzyme is modified, wherein the residue corresponding to position 252 of SEQ ID: NO: 1 is replaced with methionine, leucine and valine. In another embodiment, the dioxygenase enzyme is modified, wherein the residue corresponding to position 361 of SEQ ID NO: 1 is replaced with threonine. In another embodiment, the dioxygenase enzyme is modified, wherein the residue corresponding to position 224 of SEQ ID NO: 1 is replaced with methionine, phenylalanine and tryptophan. In another embodiment, the dioxygenase enzyme is modified, wherein the residue corresponding to position 289 of SEQ ID NO: 1 is replaced with methionine, leucine and isoleucine. In another embodiment, the dioxygenase enzyme is modified, wherein the residue corresponding to position 323 of SEQ ID NO: 1 is replaced with tryptophan, tyrosine and isoleucine. In another embodiment, the dioxygenase enzyme is modified, wherein the residue corresponding to position 367 of SEQ ID NO: 1 is replaced with methionine, leucine, isoleucine and tryptophan. In another embodiment, the dioxygenase enzyme is modified, wherein the residue corresponding to position 187 of SEQ ID NO: 1 is replaced with methionine, phenylalanine and tryptophan. In another embodiment, the dioxygenase enzyme is modified, wherein the residue corresponding to position 241 of SEQ ID NO: 1 is replaced with methionine, phenylalanine and tryptophan. In another embodiment, the dioxygenase enzyme is modified, wherein the residue corresponding to position 363 of SEQ ID NO: 1 is replaced with methionine, isoleucine and valine. In another embodiment, the dioxygenase enzyme is modified, wherein the residue corresponding to position 239 of SEQ ID NO: 1 is replaced with leucine. In another embodiment, the dioxygenase enzyme is modified, wherein the residue corresponding to position 251 of SEQ ID NO: 1 is replaced with methionine, isoleucine and proline. In another embodiment, the dioxygenase enzyme is modified, wherein the residue corresponding to position 265 of SEQ ID NO: 1 is replaced with methionine, isoleucine and proline. In another embodiment, the dioxygenase enzyme is modified, wherein the residue corresponding to position 226 of SEQ ID NO: 1 is replaced with methionine, valine, isoleucine and leucine. In another embodiment, the dioxygenase enzyme is modified, wherein the residue corresponding to position 212 of SEQ ID NO: 1 is replaced with phenylalanine, leucine, isoleucine or tryptophan. In another embodiment, the dioxygenase enzyme is modified, wherein the residue corresponding to position 217 of SEQ ID NO: 1 is replaced with methionine, isoleucine or leucine. In another embodiment, the dioxygenase enzyme is modified, wherein the residue corresponding to position 228 of SEQ ID NO: 1 is replaced with methionine, isoleucine or leucine. In another embodiment, the dioxygenase enzyme is modified, wherein the residue corresponding to position 210 of SEQ ID NO: 1 is replaced with leucine.

In some aspects, at least one of the substrate-specificity positions corresponding to amino acids selected from the group consisting of A361, F336, F347, F364, F368, F371, G362, I227, I252, L224, L289, L323, L367, N187, N241, N363, P239, Q251, Q265, S226, V212, V217, V228 and W210 of SEQ ID NO: 1 has been replaced with one of the corresponding disclosed amino acids to alter the respective substrate-specificity residue.

In some other aspects, two or more of the substrate-specificity positions corresponding to amino acids selected from the group consisting of A361, F336, F347, F364, F368, F371, G362, I227, I252, L224, L289, L323, L367, N187, N241, N363, P239, Q251, Q265, S226, V212, V217, V228 and W210 of SEQ ID NO: 1 have been replaced with one of the corresponding disclosed amino acids to alter the respective substrate-specificity residue.

In yet some other aspects, at least 3 and up to 24 of the substrate-specificity positions corresponding to amino acids selected from the group consisting of A361, F336, F347, F364, F368, F371, G362, I227, I252, L224, L289, L323, L367, N187, N241, N363, P239, Q251, Q265, S226, V212, V217, V228 and W210 of SEQ ID NO: 1 have been replaced with one of the corresponding disclosed amino acids to alter the respective substrate-specificity residue.

In some embodiments, the dioxygenase enzyme has been modified or mutated to alter one or more one of the substrate-specificity residues. In certain embodiments, the dioxygenase enzyme is modified, wherein the residue corresponding to position 361 of SEQ ID NO: 6 is replaced with a residue selected from methionine, leucine and isoleucine. In another embodiment, the dioxygenase enzyme is modified, wherein the residue corresponding to position 336 of SEQ ID NO: 6 is replaced with leucine, methionine, isoleucine and tryptophan. In another embodiment, the dioxygenase enzyme is modified, wherein the residue corresponding to position 347 of SEQ ID NO: 6 is replaced with tryptophan, tyrosine and isoleucine. In another embodiment, the dioxygenase enzyme is modified, wherein the residue corresponding to position 364 of SEQ ID NO: 6 is replaced with methionine, alanine, isoleucine, leucine and tryptophan. In another embodiment, the dioxygenase enzyme is modified, wherein the residue corresponding to position 368 of SEQ ID NO: 6 is replaced with tyrosine, tryptophan, leucine, isoleucine and methionine. In another embodiment, the dioxygenase enzyme is modified, wherein the residue corresponding to position 371 of SEQ ID NO: 6 is replaced with methionine, leucine and isoleucine. In another embodiment, the dioxygenase enzyme is modified, wherein the residue corresponding to position 362 of SEQ ID NO: 6 is replaced with methionine, leucine and isoleucine. In another embodiment, the dioxygenase enzyme is modified, wherein the residue corresponding to position 227 of SEQ ID NO: 6 is replaced with methionine, leucine and isoleucine. In another embodiment, the dioxygenase enzyme is modified, wherein the residue corresponding to position 252 of SEQ ID NO: 6 is replaced with methionine, leucine and valine. In another embodiment, the dioxygenase enzyme is modified, wherein the residue corresponding to position 361 of SEQ ID NO: 6 is replaced with threonine. In another embodiment, the dioxygenase enzyme is modified, wherein the residue corresponding to position 224 of SEQ ID NO: 6 is replaced with methionine, phenylalanine and tryptophan. In another embodiment, the dioxygenase enzyme is modified, wherein the residue corresponding to position 289 of SEQ ID NO: 6 is replaced with methionine, leucine and isoleucine. In another embodiment, the dioxygenase enzyme is modified, wherein the residue corresponding to position 323 of SEQ ID NO: 6 is replaced with tryptophan, tyrosine and isoleucine. In another embodiment, the dioxygenase enzyme is modified, wherein the residue corresponding to position 367 of SEQ ID NO: 6 is replaced with methionine, leucine, isoleucine and tryptophan. In another embodiment, the dioxygenase enzyme is modified, wherein the residue corresponding to position 187 of SEQ ID NO: 6 is replaced with methionine, phenylalanine and tryptophan. In another embodiment, the dioxygenase enzyme is modified, wherein the residue corresponding to position 241 of SEQ ID NO: 6 is replaced with methionine, phenylalanine and tryptophan. In another embodiment, the dioxygenase enzyme is modified, wherein the residue corresponding to position 363 of SEQ ID NO: 6 is replaced with methionine, isoleucine and valine. In another embodiment, the dioxygenase enzyme is modified, wherein the residue corresponding to position 239 of SEQ ID NO: 6 is replaced with leucine. In another embodiment, the dioxygenase enzyme is modified, wherein the residue corresponding to position 251 of SEQ ID NO: 6 is replaced with methionine, isoleucine and proline. In another embodiment, the dioxygenase enzyme is modified, wherein the residue corresponding to position 265 of SEQ ID NO: 6 is replaced with methionine, isoleucine and proline. In another embodiment, the dioxygenase enzyme is modified, wherein the residue corresponding to position 226 of SEQ ID NO: 6 is replaced with methionine, valine, isoleucine and leucine. In another embodiment, the dioxygenase enzyme is modified, wherein the residue corresponding to position 212 of SEQ ID NO: 6 is replaced with phenylalanine, leucine, isoleucine or tryptophan. In another embodiment, the dioxygenase enzyme is modified, wherein the residue corresponding to position 217 of SEQ ID NO: 6 is replaced with methionine, isoleucine or leucine. In another embodiment, the dioxygenase enzyme is modified, wherein the residue corresponding to position 228 of SEQ ID NO: 6 is replaced with methionine, isoleucine or leucine. In another embodiment, the dioxygenase enzyme is modified, wherein the residue corresponding to position 210 of SEQ ID NO: 6 is replaced with leucine.

In some aspects, at least one of the substrate-specificity positions corresponding to amino acids selected from the group consisting of A361, F336, F347, F364, F368, F371, G362, I227, I252, L224, L289, L323, L367, N187, N241, N363, P239, Q251, Q265, S226, V212, V217, V228 and W210 of SEQ ID NO: 6 has been replaced with one of the corresponding disclosed amino acids to alter the respective substrate-specificity residue.

In some other aspects, two or more of the substrate-specificity positions corresponding to amino acids selected from the group consisting of A361, F336, F347, F364, F368, F371, G362, I227, I252, L224, L289, L323, L367, N187, N241, N363, P239, Q251, Q265, S226, V212, V217, V228 and W210 of SEQ ID NO: 6 have been replaced with one of the corresponding disclosed amino acids to alter the respective substrate-specificity residue.

In yet some other aspects, at least 3 and up to 24 of the substrate-specificity positions corresponding to amino acids selected from the group consisting of A361, F336, F347, F364, F368, F371, G362, I227, I252, L224, L289, L323, L367, N187, N241, N363, P239, Q251, Q265, S226, V212, V217, V228 and W210 of SEQ ID NO: 6 have been replaced with one of the corresponding disclosed amino acids to alter the respective substrate-specificity residue.

In an exemplary embodiment, the modified dioxygenase enzyme is derived from a corresponding unmodified dioxygenase that is at least about 65%, 70%, 75%, 80%, 85%, 90%, 91%, 92%, 93%, 94%, 95%, 96%, 97%, 98%, 99%, or 99.5% identical to a polypeptide selected from any of SEQ ID NOS: 1-8.

In some embodiments, the present disclosure relates to a polypeptide with increased βHIV synthase activity, wherein the polypeptide sequence is derived from *Yarrowia lipolytica* and is at least 65% identical to a polypeptide selected from either of SEQ ID NOs: 4-5 and has been modified or mutated to alter one or more of the substrate-specificity residues. In certain embodiments, the polypeptide is modified at one or more positions corresponding to amino acids selected from A374, F349, F360, F377, F381, 1384, G375, V240, 1265, A374, L237, 1302, L336, L380, N200, N254, N377, P252, Q264, Q278, S239, V225, 1230, V241 and W223. In an exemplary embodiment, the modified decarboxylase enzyme is derived from a corresponding unmodified decarboxylase that is at least about 65%, 70%, 75%, 80%, 85%, 90%, 91%, 92%, 93%, 94%, 95%, 96%, 97%, 98%, 99%, or 99.5% identical to a polypeptide selected from either of SEQ ID NOs: 4-5.

Corresponding amino acids in other decarboxylases are easily identified by visual inspection of the amino acid sequences or by using commercially available homology software programs. Thus, given the defined regions for changes and the assays described in the present application, one with skill in the art can make one or a number of modifications which would result in an increased ability to specifically catalyze the conversion of KIC to βHIV, in any homologous dioxygenase enzyme of interest.

The modified polypeptides can be optimally aligned with the corresponding unmodified, wild-type dioxygenase enzymes to generate a similarity score which is at least about 50%, more preferably at least about 60%, more preferably at least about 70%, more preferably at least about 80%, more preferably at least about 90%, or most preferably at least about 95% of the score for the reference sequence using the BLOSUM82 matrix, with a gap existence penalty of 11 and a gap extension penalty of 1.

In some embodiments, the non-natural βHIV synthase enzyme comprises fragments of the disclosed polypeptides, which comprises at least 25, 30, 40, 50, 100, 150, 200, 250, 300 or 375 amino acids and retain βHIV synthase activity. Such fragments may be obtained by deletion mutation, by recombinant techniques that are routine and well-known in the art, or by enzymatic digestion of the polypeptides of interest using any of a number of well-known proteolytic enzymes.

In addition, as is understood by the skilled artisan, not all positions within an enzyme are created equal. Certain "permissive sites" are more likely to accommodate mutations without affecting activity or stability. In a sequence family such as the 4-hydroxyphenylpyruvate dioxygenase (HPPD), there are hundreds of sites that are more permissive to mutation than other sites. One method to identify permissive sites is by quantifying the extent to which each site has variable amino acids among a collection of homologs. A standard calculation to quantify this variability is to compute the sequence entropy for each site.

In an example calculation, selection of sequences was initiated by performing a blastp (version 2.7.1+, default parameters) search against the NCBI nr database using the SEQ ID NO: 1 as the query. Of the 5000 sequences retrieved, the top 246 BLAST hits were selected for further analysis as this group was largely made up of mammalian sequences, whereas lower ranked sequenced were predominately non mammalian. Identical sequences were grouped using CD-HIT2 (c flag=1.0) and a single sequence was chosen from each group. The remaining 219 unique sequences were then aligned using clustal-w2 (version 2.0.12, default parameters) and the alignment visually inspected using Jalview (version 2.11.1-3). Sequences with poorly aligned regions, likely resulting from miscalled coding regions, were eliminated. This resulted in a final curated set of 140 sequences. These sequences, corresponding to SEQ ID NOs: 9-148, were aligned using multiple sequence alignment. Accordingly, the multiple sequence alignment has a number of gaps. Typically, sequence identity is calculated by counting the number of matching amino acids after aligning two sequences, ignoring gaps in the alignment. To proceed, the analysis was limited to positions in the multiple sequence alignment where at least half of the sequences (>=70) have an amino acid rather than a gap. Furthermore, for numbering simplicity, only sites for which a reference sequence (SEQ ID NO: 1) has an amino acid rather than a gap were considered. This resulted in 393 aligned positions. For each of these aligned positions, the sequence entropy (FIG. 5) was calculated. First, the probability P, of observing each amino acid variant found at this site was calculated. Then the sum of −P*ln(P) over all amino acid variants at this site was calculated. If the site is completely conserved (common to all 140 aligned sequences), the sequence entropy would be 0. In contrast, if all 20 amino acids were found with equal probability, the sequence entropy would be 3.0.

Several positions within the multiple sequence alignment are diverse, with significant sequence entropy. Of the 393 positions, this example shows that 193 have sequence entropy exceeding a threshold of 0.05, 177 also exceed 0.10, 131 also exceed 0.20, and 84 also exceed 0.40. For example, the site for SER175 from SEQ ID NO: 1 has sequence entropy=1.822. At this site 9 amino acid variants are represented, with the most common variants being SER (42/140), LYS (30/140), ASN (28/140), ARG (15/140), GLN (8/140), THR (7/140), ASP (5/140), HIS (4/140), and ALA (1/140).

As used herein, a permissive site exceeds a specified sequence entropy threshold using the code illustrated in FIG. 5. Using a threshold level of 0.05 for permissive sites, the following positions corresponding to residues in SEQ ID NO: 1 residues are relatively permissive sites within the multiple sequence alignment: 1, 2, 3, 4, 5, 6, 7, 8, 9, 10, 12, 13, 15, 17, 22, 33, 34, 35, 38, 40, 43, 44, 45, 48, 53, 56, 57, 58, 61, 62, 63, 64, 65, 66, 68, 70, 71, 72, 74, 78, 79, 80, 81, 82, 84, 87, 92, 96, 97, 101, 104, 105, 106, 107, 111, 112, 113, 116, 117, 118, 119, 121, 123, 125, 127, 128, 130, 133, 135, 136, 139, 147, 149, 150, 151, 153, 155, 160, 161, 162, 163, 164, 165, 166, 168, 169, 171, 172, 175, 176, 177, 179, 180, 181, 184, 188, 189, 191, 192, 194, 195, 196, 197, 198, 201, 202, 203, 205, 215, 217, 220, 221, 223, 227, 229, 230, 232, 235, 245, 247, 251, 256, 257, 259, 262, 267, 268, 269, 270, 272, 275, 276, 277, 278, 279, 280, 282, 283, 286, 287, 289, 290, 291, 293, 294, 297, 298, 300, 301, 302, 304, 305, 306, 308, 309, 311, 313, 314, 315, 316, 318, 321, 322, 324, 326, 328, 329, 332, 340, 346, 350, 352, 354, 365, 366, 369, 371, 373, 374, 376, 377, 382, 383, 384, 385, 386, 387, 388, 389, 390, 391, 392 and 393.

In contrast, sites below a specified sequence entropy threshold can be used to identify relatively non-permissive sites. Accordingly, as used herein, a non-permissive site falls below a specified threshold using the code illustrated in FIG. 5. Using a threshold level of <0.05 for non-permissive sites, the following positions corresponding to residues in SEQ ID NO: 1 are relatively non-permissive sites within the multiple sequence alignment: 11, 14, 16, 18, 19, 20, 21, 23, 24, 25, 26, 27, 28, 29, 30, 31, 32, 36, 37, 39, 41, 42, 46, 47, 49, 50, 51, 52, 54, 55, 59, 60, 67, 69, 73, 75, 76, 77, 83, 85, 86, 88, 89, 90, 91, 93, 94, 95, 98, 99, 100, 102, 103, 108, 109, 110, 114, 115, 120, 122, 124, 126, 129, 131, 132, 134, 137, 138, 140, 141, 142, 143, 144, 145, 146, 148, 152, 154, 156, 157, 158, 159, 167, 170, 173, 174, 178, 182, 183, 185, 186, 187, 190, 193, 199, 200, 204, 206, 207, 208, 209, 210, 211, 212, 213, 214, 216, 218, 219, 222, 224, 225, 226, 228, 231, 233, 234, 236, 237, 238, 239, 240, 241, 242, 243, 244, 246, 248, 249, 250, 252, 253, 254, 255, 258, 260, 261, 263, 264, 265, 266, 271, 273, 274, 281, 284, 285, 288, 292, 295, 296, 299, 303, 307, 310, 312, 317, 319, 320, 323, 325, 327, 330, 331, 333, 334, 335, 336, 337, 338, 339, 341, 342, 343, 344, 345, 347, 348, 349, 351, 353, 355, 356, 357, 358, 359, 360, 361, 362, 363, 364, 367, 368, 370, 372, 375, 378, 379, 380 and 381.

In certain embodiments, the threshold level may be set at 0.10. Using a threshold level of >0.10 for permissive sites, the following positions corresponding to residues in SEQ ID NO: 1 residues are relatively permissive sites within the multiple sequence alignment: 1, 2, 3, 4, 5, 6, 7, 9, 10, 12, 13, 15, 17, 22, 33, 34, 35, 38, 40, 43, 44, 45, 48, 53, 56, 57, 58, 61, 62, 63, 65, 66, 68, 70, 71, 72, 74, 78, 79, 80, 84, 87, 92, 96, 97, 104, 105, 106, 111, 112, 113, 116, 117, 118, 119, 123, 125, 127, 128, 130, 133, 136, 139, 147, 149, 150, 151, 153, 155, 160, 161, 162, 163, 164, 165, 166, 168, 169, 171, 172, 175, 176, 177, 179, 180, 181, 184, 188, 189, 191, 192, 194, 195, 196, 197, 198, 201, 202, 205, 215, 217, 220, 221, 223, 227, 229, 230, 232, 235, 245, 247, 251, 257, 259, 262, 267, 268, 269, 270, 272, 276, 277, 278, 279, 280, 282, 283, 286, 289, 290, 291, 293, 294, 297, 298, 300, 301, 302, 305, 306, 308, 309, 313, 314, 315, 316, 321, 324, 326, 328, 329, 332, 340, 346, 350, 352, 354, 365, 366, 369, 371, 373, 374, 376, 377, 382, 383, 384, 385, 386, 387, 388, 389, 390, 391, 392, 393. Likewise, using a threshold level of <0.10 for non-permissive sites, the following positions corresponding to SEQ ID NO: 1 residues are relatively non-permissive sites within the multiple sequence alignment: 8, 11, 14, 16, 18, 19, 20, 21, 23, 24, 25, 26, 27, 28, 29, 30, 31, 32, 36, 37, 39, 41, 42, 46, 47, 49, 50, 51, 52, 54, 55, 59, 60, 64, 67, 69, 73, 75, 76, 77, 81, 82, 83, 85, 86, 88, 89, 90, 91, 93, 94, 95, 98, 99, 100, 101, 102, 103, 107, 108, 109, 110, 114, 115, 120, 121, 122, 124, 126, 129, 131, 132, 134, 135, 137, 138, 140, 141, 142, 143, 144, 145, 146, 148, 152, 154, 156, 157, 158, 159, 167, 170, 173, 174, 178, 182, 183, 185, 186, 187, 190, 193, 199, 200, 203, 204, 206, 207, 208, 209, 210, 211, 212, 213, 214, 216, 218, 219, 222, 224, 225, 226, 228, 231, 233, 234, 236, 237, 238, 239, 240, 241, 242, 243, 244, 246, 248, 249, 250, 252, 253, 254, 255, 256, 258, 260, 261, 263, 264, 265, 266, 271, 273, 274, 275, 281, 284, 285, 287, 288, 292, 295, 296, 299, 303, 304, 307, 310, 311, 312, 317, 318, 319, 320, 322, 323, 325, 327, 330, 331, 333, 334, 335, 336, 337, 338, 339, 341, 342, 343, 344, 345, 347, 348, 349, 351, 353, 355, 356, 357, 358, 359, 360, 361, 362, 363, 364, 367, 368, 370, 372, 375, 378, 379, 380, 381.

In certain embodiments, the threshold level may be set at 0.20. Using a threshold level of >0.20 for permissive sites, the following positions corresponding to SEQ ID NO: 1 residues are relatively permissive sites within the multiple sequence alignment: 1, 3, 5, 6, 7, 9, 12, 13, 15, 22, 35, 38, 40, 43, 44, 45, 48, 57, 58, 62, 65, 66, 68, 70, 71, 72, 78, 80, 84, 96, 97, 104, 105, 111, 113, 116, 117, 118, 119, 123, 125, 128, 130, 133, 150, 151, 153, 155, 160, 161, 162, 163, 164, 165, 166, 168, 169, 171, 172, 175, 176, 177, 179, 180, 184, 191, 194, 195, 196, 197, 198, 201, 202, 205, 215, 217, 221, 223, 227, 230, 235, 245, 247, 257, 259, 262, 270, 272, 276, 277, 279, 280, 282, 283, 286, 289, 290, 293, 294, 297, 298, 302, 305, 309, 313, 314, 316, 321, 326, 340, 346, 354, 365, 366, 369, 371, 373, 374, 376, 377, 383, 384, 385, 386, 387, 388, 389, 390, 391, 392, 393. Likewise, using a threshold level of <0.20 for non-permissive sites, the following positions corresponding to SEQ ID NO: 1 residues are relatively non-permissive sites within the multiple sequence alignment: 2, 4, 8, 10, 11, 14, 16, 17, 18, 19, 20, 21, 23, 24, 25, 26, 27, 28, 29, 30, 31, 32, 33, 34, 36, 37, 39, 41, 42, 46, 47, 49, 50, 51, 52, 53, 54, 55, 56, 59, 60, 61, 63, 64, 67, 69, 73, 74, 75, 76, 77, 79, 81, 82, 83, 85, 86, 87, 88, 89, 90, 91, 92, 93, 94, 95, 98, 99, 100, 101, 102, 103, 106, 107, 108, 109, 110, 112, 114, 115, 120, 121, 122, 124, 126, 127, 129, 131, 132, 134, 135, 136, 137, 138, 139, 140, 141, 142, 143, 144, 145, 146, 147, 148, 149, 152, 154, 156, 157, 158, 159, 167, 170, 173, 174, 178, 181, 182, 183, 185, 186, 187, 188, 189, 190, 192, 193, 199, 200, 203, 204, 206, 207, 208, 209, 210, 211, 212, 213, 214, 216, 218, 219, 220, 222, 224, 225, 226, 228, 229, 231, 232, 233, 234, 236, 237, 238, 239, 240, 241, 242, 243, 244, 246, 248, 249, 250, 251, 252, 253, 254, 255, 256, 258, 260, 261, 263, 264, 265, 266, 267, 268, 269, 271, 273, 274, 275, 278, 281, 284, 285, 287, 288, 291, 292, 295, 296, 299, 300, 301, 303, 304, 306, 307, 308, 310, 311, 312, 315, 317, 318, 319, 320, 322, 323, 324, 325, 327, 328, 329, 330, 331, 332, 333, 334, 335, 336, 337, 338, 339, 341, 342, 343, 344, 345, 347, 348, 349, 350, 351, 352, 353, 355, 356, 357, 358, 359, 360, 361, 362, 363, 364, 367, 368, 370, 372, 375, 378, 379, 380, 381, 382.

In certain embodiments, the threshold level may be set at 0.40. Using a threshold level of >0.40 for permissive sites, the following positions corresponding to SEQ ID NO: 1 residues are relatively permissive sites within the multiple sequence alignment: 3, 5, 6, 9, 12, 35, 38, 48, 62, 66, 71, 72, 104, 105, 116, 118, 119, 123, 125, 128, 133, 150, 151, 153, 155, 160, 162, 163, 164, 165, 166, 168, 169, 171, 175, 177, 179, 180, 184, 194, 198, 201, 202, 230, 235, 245, 247, 270, 272, 277, 279, 280, 282, 283, 286, 290, 293, 294, 297, 298, 302, 305, 309, 313, 314, 316, 321, 340, 354, 366, 373, 376, 377, 383, 384, 385, 386, 387, 388, 389, 390, 391, 392, 393. Likewise, using a threshold level of <0.40 for non-permissive sites, the following positions corresponding to SEQ ID NO: 1 residues are relatively non-permissive sites within the multiple sequence alignment: 1, 2, 4, 7, 8, 10, 11, 13, 14, 15, 16, 17, 18, 19, 20, 21, 22, 23, 24, 25, 26, 27, 28, 29, 30, 31, 32, 33, 34, 36, 37, 39, 40, 41, 42, 43, 44, 45, 46, 47, 49, 50, 51, 52, 53, 54, 55, 56, 57, 58, 59, 60, 61, 63, 64, 65, 67, 68, 69, 70, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 106, 107, 108, 109, 110, 111, 112, 113, 114, 115, 117, 120, 121, 122, 124, 126, 127, 129, 130, 131, 132, 134, 135, 136, 137, 138, 139, 140, 141, 142, 143, 144, 145, 146, 147, 148, 149, 152, 154, 156, 157, 158, 159, 161, 167, 170, 172, 173, 174, 176, 178, 181, 182, 183, 185, 186, 187, 188, 189, 190, 191, 192, 193, 195, 196, 197, 199, 200, 203, 204, 205, 206, 207, 208, 209, 210, 211, 212, 213, 214, 215, 216, 217, 218, 219, 220, 221, 222, 223, 224, 225, 226, 227, 228, 229, 231, 232, 233, 234, 236, 237, 238, 239, 240, 241, 242, 243, 244, 246, 248, 249, 250, 251, 252, 253, 254, 255, 256, 257, 258, 259, 260, 261, 262, 263, 264, 265, 266, 267, 268, 269, 271, 273, 274, 275, 276, 278, 281, 284, 285, 287, 288, 289, 291, 292, 295, 296, 299, 300, 301, 303, 304, 306, 307, 308, 310, 311, 312, 315, 317, 318, 319, 320, 322, 323, 324, 325, 326, 327, 328, 329, 330, 331, 332, 333, 334, 335, 336, 337, 338, 339, 341, 342, 343, 344, 345, 346, 347, 348, 349, 350, 351, 352, 353, 355, 356, 357, 358, 359, 360, 361, 362, 363, 364, 365, 367, 368, 369, 370, 371, 372, 374, 375, 378, 379, 380, 381, 382.

Directed evolution can be considered as an orthogonal method for enzyme improvement that can be used either by itself or in conjunction with rational design (see Arnold, F., Acc. Chem. Res. 1998, 31, 125-131 and Johannes and Zhao, Curr Opinion in Microbiol 2006, 9:261-267 for more information). Unlike rational design that depends on structural modeling and scoring functions to identify specific residues to mutate, directed evolution relies on simple yet powerful principles of mutation. Starting from a single target gene that encodes for the parent enzyme, a library of mutant genes is created through mutagenesis and/or gene recombination. Iterative accumulation of small improvements identified using multiple rounds of diversification and screening can lead to substantial net enzyme improvements. Methods to subject enzymes through directed evolution are well-characterized in the literature (see for example, Bloom et al, Current Opinion in Structural Biology 2005, 15:447-452). In some embodiments, the non-natural βHIV synthase is subjected to directed evolution and variants with higher βHIV synthase activity are selected.

Accordingly, in some embodiments, the present disclosure provides a nucleic acid molecule encoding a modified dioxygenase, wherein said modified dioxygenase is derived from a corresponding wild-type, unmodified dioxygenase, wherein the sequence of non-permissive sites within said modified dioxygenase is at least about 60%, at least about 70%, at least about 80%, or at least about 90% identical to the sequence of non-permissive sites within the corresponding wild-type, unmodified dioxygenase. In one embodiment, the threshold level for distinguishing between permissive and non-permissive sites using the code illustrated in FIG. 5 is 0.05. In certain other embodiments, the threshold level for distinguishing between permissive and non-permissive sites using the code illustrated in FIG. 5 is selected from 0.1, 0.2 and 0.4. In an exemplary embodiment, the modified dioxygenase enzyme is derived from a corresponding wild-type, unmodified dioxygenase selected from any of SEQ ID NOs: 1-148. In some embodiments, the corresponding wild-type, unmodified dioxygenase is obtained from *Rattus* species. In a further exemplary embodiment, the corresponding wild-type, unmodified dioxygenase is obtained from *Rattus* species classified into a genera selected from the group consisting of *Rattus norvegicus, Rattus rattus, R. xanthurus, R. leucopus* and *R. fuscipes*. In another further exemplary embodiment, the corresponding wild-type, unmodified dioxygenase is obtained from *Homo sapiens*. In another further embodiment, the corresponding wild-type, unmodified dioxygenase is obtained from *Arabidopsis*. In another further exemplary embodiment, the corresponding wild-type, unmodified dioxygenase is obtained from *Yarrowia*. In another further exemplary embodiment, the corresponding wild-type, unmodified dioxygenase is obtained from *Pseudomonas*. In another further exemplary embodiment, the corresponding wild-type, unmodified dioxygenase is obtained from *Streptomyces*. In an exemplary embodiment, the corresponding wild-type, unmodified dioxygenase is obtained from *Rattus norvegicus*. In another exemplary embodiment, the corresponding wild-type, unmodified dioxygenase is 4-hydroxyphenyl pyruvate dioxygenase (SEQ ID NO: 1-3).

In accordance with the present disclosure, any number of mutations can be made to the dioxygenase enzymes, and in certain embodiments, multiple mutations can be made to result in an increased ability to catalyze the conversion of KIC to βHIV with high catalytic efficiency. Such mutations can include point mutations, frame shift mutations, deletions, and insertions. In certain embodiments, one or more (e.g., one, two, three, four, five, six, seven, eight, nine, ten or more, etc.) point mutations may be preferred.

In some embodiments, the βHIV synthase will have an intact C-terminus. As defined herein, the C-terminus of βHIV synthase is the stretch of residues that include the C-terminal α-helix that shields the active site. For example, in SEQ ID NO: 1, the stretch of amino acids from 361 to 393 are considered the C-terminus. In some embodiments, the residues comprising the C-terminus are modified to allow increased activity with KIC. In some embodiments, the C-terminus of the βHIV synthase is engineered to favor a conformation with high specificity for KIC.

In some embodiments, the non-natural microorganism comprises at least one nucleic acid molecule encoding a polypeptide with βHIV synthase activity, wherein said polypeptide is at least about 65% identical to a polypeptide selected from SEQ ID NOS: 1-149. Further within the scope of present disclosure are recombinant microorganisms comprising at least one nucleic acid molecule encoding a polypeptide with βHIV synthase activity, wherein said polypeptide is at least about 70%, 75%, 80%, 85%, 90%, 91%, 92%, 93%, 94%, 95%, 96%, 97%, 98%, 99%, or 99.5% identical to a polypeptide selected from SEQ ID NOS: 1-149.

In some embodiments, the subject of the present disclosure relates to a non-natural microorganism having an active βHIV metabolic pathway from pyruvate to βHIV.

A βHIV metabolic pathway is shown in FIG. 1. In some embodiments, βHIV metabolic pathway comprises of the conversion of pyruvate into 2-acetolactate, 2-acetolactate into 2,3-dihydroxy-isovalerate, 2,3-dihydroxy-isovalerate into α-ketoisovalerate, α-ketoisovalerate into 2-isopropylmalate, 2-isopropylmalate into 3-isopropylmalate, 3-isopropylmalate into KIC and KIC into βHIV.

Another βHIV metabolic pathway is shown in FIG. 2. In some embodiments, HIV metabolic pathway comprises of the conversion of pyruvate into 2-acetolactate, 2-acetolactate into 2,3-dihydroxy-isovalerate, 2,3-dihydroxy-isovalerate into α-ketoisovalerate, α-ketoisovalerate into 2-isopropylmalate, 2-isopropylmalate into 2-isopropylmaleate, 2-isopropylmaleate into 3-isopropylmalate, 3-isopropylmalate into 2-isopropyl-3-oxosuccinate, 2-isopropyl-3-oxosuccinate into KIC, KIC into βHIV.

In some embodiments, the βHIV pathway also comprises a hydroxy acid transporter to facilitate the export of βHIV formed inside the microorganism to extracellular environment.

In some embodiments, the non-natural microorganism belongs to a genus selected from the group consisting of *Escherichia, Corynebacterium, Lactobacillus, Lactococcus* and *Bacillus*. In some embodiments, the non-natural microorganism belongs to a genus selected from the group consisting of *Saccharomyces, Kluyveromyces, Galactomyces, Pichia* and *Candida*.

In some embodiments where the non-natural microorganism is a eukaryote, the βHIV metabolic pathway is expressed or overexpressed in its cytosol.

In certain embodiments, the non-natural microorganism comes in contact with a carbon source in a fermenter to produce βHIV and introducing into the fermenter sufficient nutrients where the final concentration of β-hydroxyisovalerate concentration in the fermentation broth is greater than about 10 mg/L (for example, greater than about 100 mg/L, for example, greater than about 1 g/L, greater than about 5 g/L, greater than about 10 g/L, greater than about 20 g/L, greater than about 40 g/L, greater than 50 g/L), but usually below 150 g/L. In certain embodiments, the carbon source is selected from the group consisting of glucose, xylose, arabinose, sucrose, fructose, lactose, glycerol, and mixtures thereof.

In some embodiments, βHIV production is achieved in a "cell-free" process. Cell-free production provides an alternative approach to chemical transformations that can ease the technical challenges of engineering microorganisms and the limitations imposed by requiring cell viability (Dudley, Q. M., Karim, A. S. and Jewett, M. C., 2015. Biotechnology journal, 10 (1), pp. 69-82). In certain embodiments, βHIV synthase is contacted with KIC in a suitable buffer in the presence of cofactors and cosubstrates such that the conditions are amenable for the conversion of KIC into βHIV. In some embodiments, βHIV thus produced is optionally recovered from the fermentation broth by first removing the cells, followed by separating the aqueous phase from the clarified fermentation broth along with the other by-products of the fermentation. In some embodiments, the βHIV is co-purified with other fermentation-derived products, wherein the composition comprises at least one fermentation-derived impurity. In some embodiments, fermentation-derived products are selected from the group consisting of organic acids and amino acids. In some embodiments, βHIV synthesized according to the present disclosure is substantially devoid of chloroform or hydrochloric acid.

The object of the present disclosure is further illustrated by the following examples that should not be construed as limiting. Examples are provided for clarity of understanding. While the object of the present disclosure has been described in connection with embodiments thereof, it will be understood that it is capable of further modifications and this disclosure is intended to cover variations, user or adaptations of the present disclosure following, in general, the principles of the present disclosure and including such departures from the present disclosure as come within known or customary practice within the art to which the present disclosure pertains and as may be applied to the essential features hereinbefore set forth and as follows in the scope of the appended claims. The contents of all references, patents, and published patent applications cited throughout this application, as well as the Figures and the Sequence Listings, are incorporated herein by reference for all purposes.

EXAMPLES

Example 1: Identification of Dioxygenase Enzymes with High βHIV Synthase Activity Example 1 demonstrates the promiscuity of 4-hydroxyphenylpyruvate dioxygenase (HPPD) enzymes and identification of preferred enzymes with higher activity with KIC. Exemplary HPPD enzymes were selected from human (P32754), rat (P32755), *A. thaliana* (P93836), *P. aeruginosa* (Q91576), *Y. lipolytica* (Q6CDR5) and *S. avermitilis* (Q53586). Hydroxymandelate synthase from *A. orientalis* (052791) was also selected. Codon-optimized genes encoding these enzymes were synthesized and cloned into pET28 vector for expression in *E. coli* BL21 Rosetta cells. The genes also contained a hexa-histidine tag at the N-terminus to allow easy purification. Cells from overnight cultures were harvested and lysed. The enzymes were purified with Qiagen Ni-NTA columns and the concentration of the purified enzyme was quantified with Qubit 4 (ThermoFisher).

Enzyme activity was measured by monitoring the dissolved oxygen concentration in the reaction mixture. The reaction was performed in 0.2 M Tris-Maleate buffer (pH 6.5) containing 1 mM $FeSO_4$, 0.5 mM ascorbic acid and 1 mM dithiothreitol. Purified enzyme was added to the reaction mixture and incubated at 30° C. The reaction was started by adding 1 mM KIC and the decrease in the concentration of dissolved oxygen was monitored using a Clarke electrode in Oxytherm (Hansatech Instruments). Enzyme activity was calculated from the rate of decrease in the dissolved oxygen after correcting for the slope prior to the substrate addition. One unit of volumetric enzyme activity is defined as the amount of enzyme required to consume 1 nmol of dissolved oxygen per minute under the assay conditions. Activity is expressed as specific activity, which is calculated as volumetric enzyme activity normalized by the total enzyme in the reaction mixture.

Table 1 summarizes the specific activity of exemplary dioxygenases using HPP or KIC as substrates. The rat HPPD exhibited high activity using HPP or KIC as the substrate. The rat HPPD exhibited the highest KIC activity among the enzymes studied, followed by the human HPPD and *Y. lipolytica* HPPD. The human enzyme had the highest KIC/HPP ratio for the specific activity. Hydroxymandelate synthase from *A. orientalis* exhibited even higher activity with HPP than the rat enzyme and converts HPP into hydroxymandelate using a mechanism that is believed to have evolved differently than that in HPPD.

TABLE 1

Specific dioxygenase activity of exemplary enzymes using KIC or HPP as substrates. The sequence identity with the rat HPPD is also shown.

| | | Specific Activity | | |
|---|---|---|---|---|
| Enzyme | ID % | HPP | KIC | KIC/HPP |
| Human (P32754) | 89.8% | 0.52 | 0.28 | 0.54 |
| Rat (P32755) | 100.0% | 17.98 | 0.70 | 0.04 |
| A. thaliana (P93836) | 27.3% | 0.65 | 0.17 | 0.26 |
| Y. lipolytica (Q6CDR5) | 49.5% | 6.02 | 0.23 | 0.04 |
| P. aeruginosa (Q9I576) | 24.1% | 0.80 | 0.19 | 0.24 |
| S. avermitilis (Q53586) | 43.2% | 0.41 | 0.11 | 0.27 |
| A. orientalis (O52791) | 26.2% | 26.50 | 0.20 | 0.01 |

As a result of the high sequence identity between the human and the rat dioxygenases, there are relatively few amino acid differences that are close to the catalytic iron site. Species differences in activity with HPP and KIC may be due to different structure or dynamics of the C-terminal helix. Information is scare on the conformation of the C-terminal α-helix and its relationship with rate and specificity. Factors independent of sequence identity may also contribute to βHIV synthase activity. Accordingly, the present disclosure discloses methods to select dioxygenase enzymes that have high βHIV synthase activity.

Example 2: Engineering Dioxygenase for Improved KIC Activity

Example 2 demonstrates methods to mutate or modify certain permissive sites as identified in the description to identify mutated or modified dioxygenase variants that have improved activity with KIC. Exemplary permissive amino acid residues in SEQ ID NO: 1 were mutated one at a time to evaluate their impact on KIC activity. The residues selected for illustrative purpose were F371, V212, F364 and Q251. These native residues were mutated using Q5® Site-Directed Mutagenesis Kit (New England Biolabs, Ipswich, MA, USA) according to the manufacturer's protocol. The integrity of the mutated variants was confirmed by Sanger sequencing and transformed into E. coli Rosetta BL21 cells for expression. The activity of these variants was assayed using the procedure described in Example 1.

Figure 3:
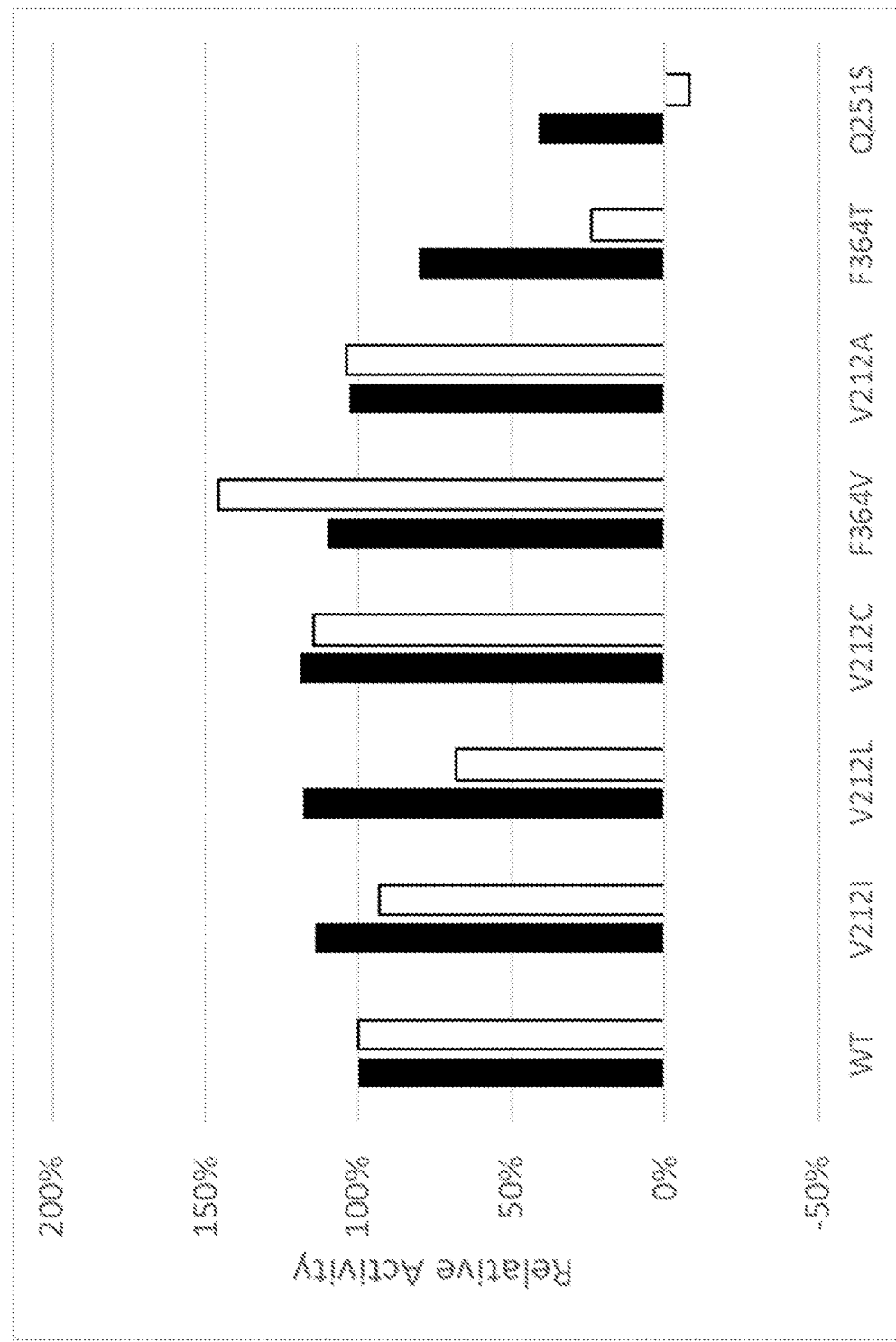
FIG. 3 is a bar graph illustrating the relative activity of exemplary βHIV synthase variants with at least one mutation that have different activity with HPP (open bars) and KIC (closed bars), according to certain embodiments of the present invention.

The relative activity of the non-natural enzyme variants is shown in FIG. 3. As exemplified in FIG. 3, not all mutations have a similar impact on the relative activity using KIC or HPP as the substrate. Some enzyme variants exhibited increased activity with KIC and others exhibited increased activity with HPP, relative to the corresponding activity of the unmutated natural wild-type enzyme. Accordingly, example 2 demonstrates methods to make amino acid changes in permissive sites and identify enzyme variants that have increased activity with KIC.

Example 3: Improved βHIV Synthase Enzymes

Example 3 further builds on the Example 2 to demonstrate how mutation or modification of residues at multiple permissive sites simultaneously can result in improved activity with KIC that may not be possible with individual changes alone. Rather than being constrained into using nucleotide degenerate codons, variant spread-out low diversity libraries were synthesized. The enzyme variants cloned into pET28a plasmid were transformed into E. coli BL21 Rosetta cells to obtain individual colonies, which were grown overnight. The cells were collected, lysed in lysis buffer (200 mM NaCl, 50 mM Tris-HCl pH 8.0, 200 µg/mL Lysozyme, 5 U/mL DNase, Sigma P8849 protease inhibitor cocktail) and the lysate was used to assay the dioxygenase activity using HPP or KIC as the substrates.

Figure 4:
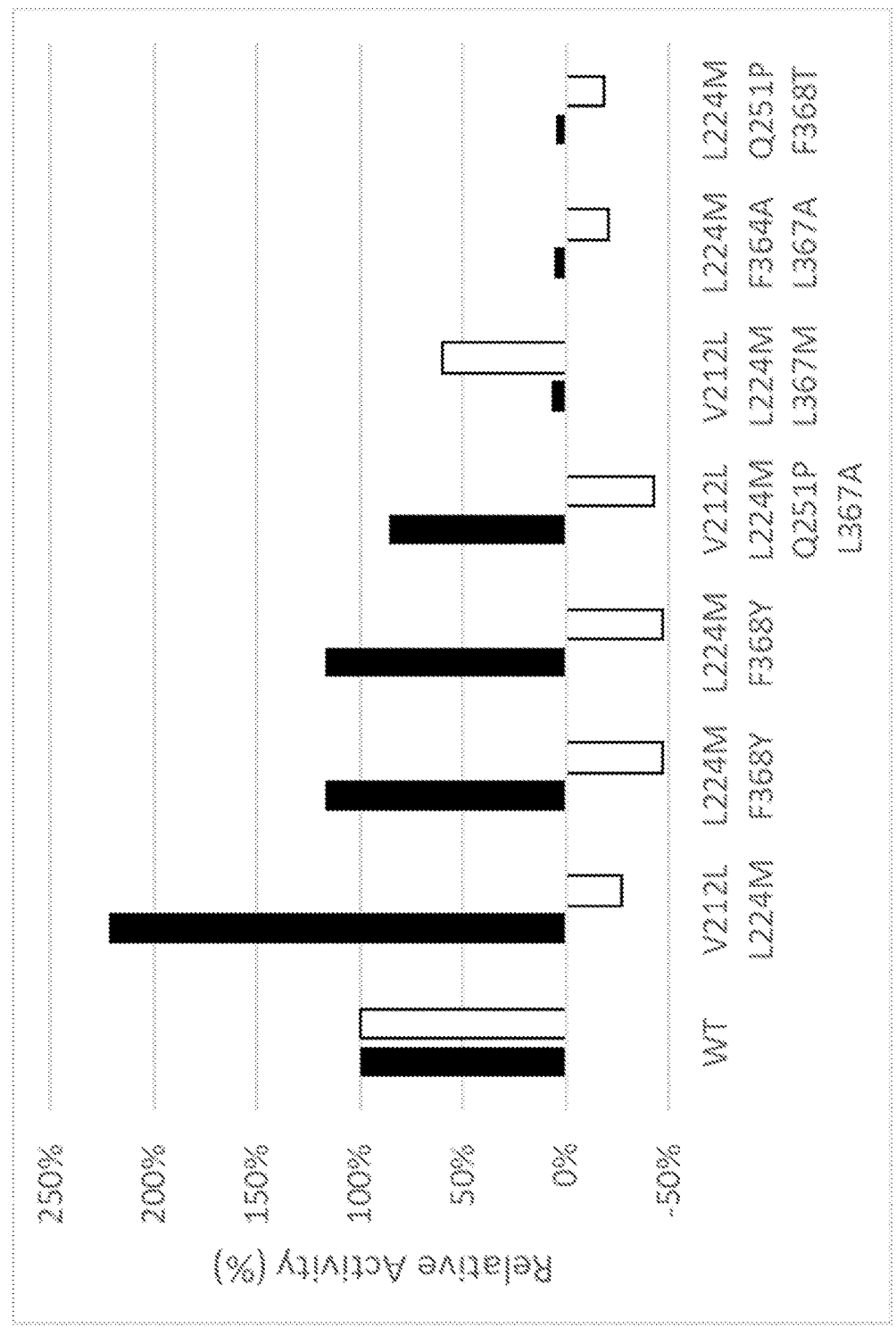
FIG. 4 is a bar graph illustrating the relative activity of exemplary βHIV synthase variants with more than one mutation that have different activity with HPP (open bars) and KIC (closed bars), according to certain embodiments of the present invention.
Figure 6:
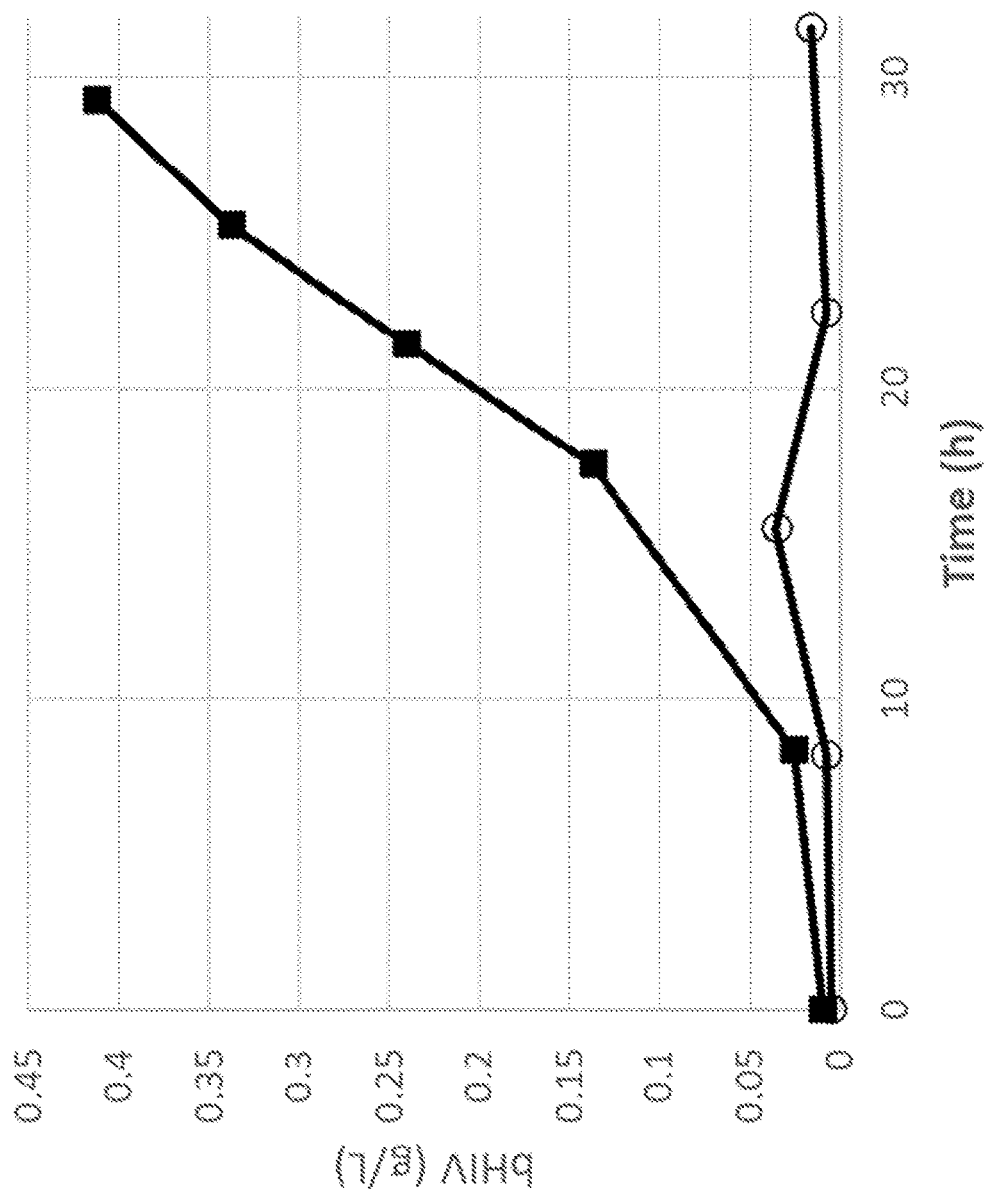
FIG. 6 is a plot illustrating bacterial production of HIV, according to certain embodiments of the present invention.
Figure 7:
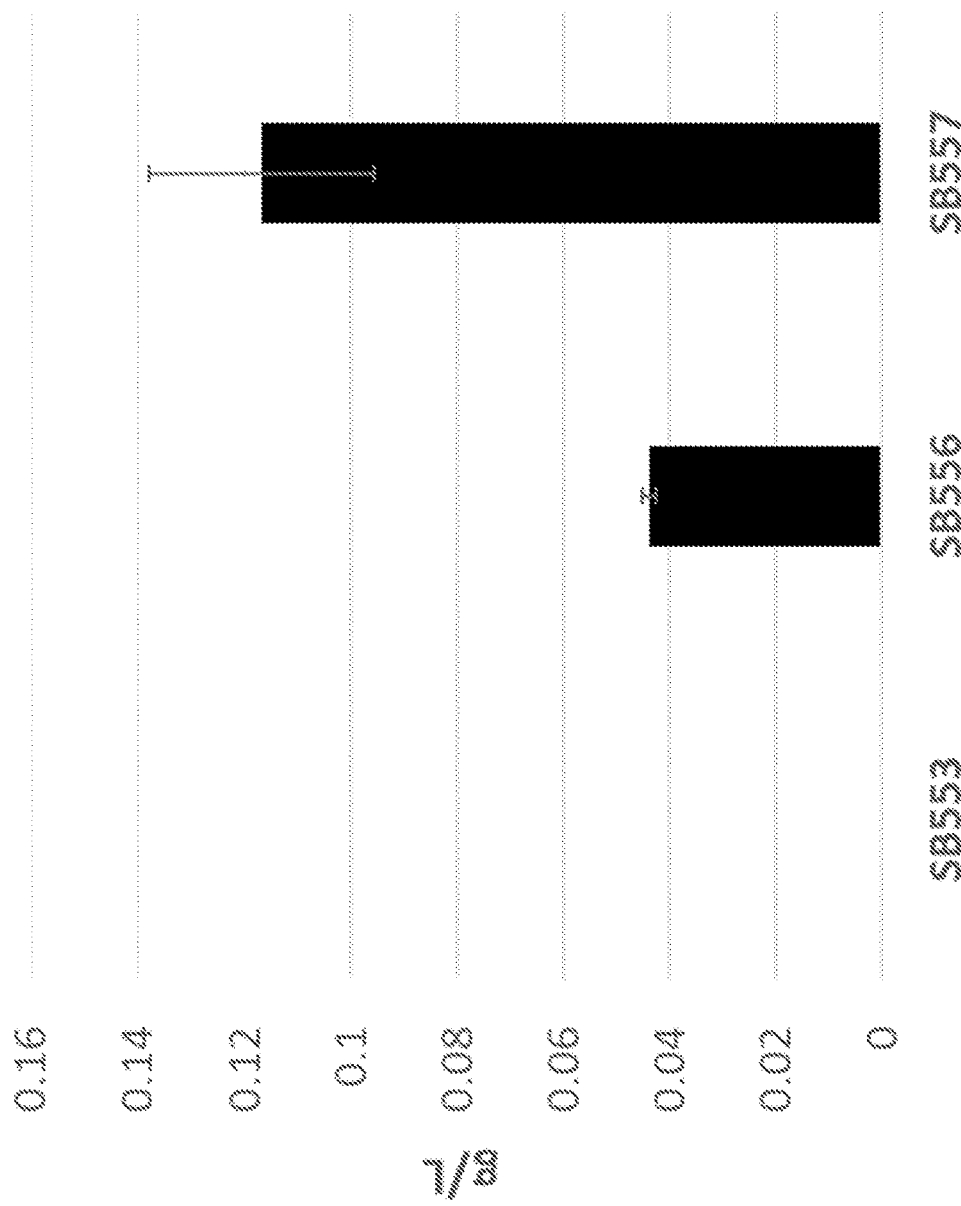
FIG. 7 is a bar graph illustrating increased βHIV production by a yeast using a non-natural βHIV synthase, according to certain embodiments of the present invention.

FIG. 4 illustrates the relative activity of the non-natural βHIV synthase enzyme variants compared with that of unmodified SEQ ID NO: 1. Mutations to multiple permissive sites increased the relative activity with KIC. For example, the combination of mutations at residues at V212 and L224 appeared to increase the enzyme activity significantly with KIC and reduced the enzyme activity with HPP. Since these two residues are in close proximity to the C-terminal helix, these mutations are likely to affect the structure, dynamics, or both for the C-terminal helix. Additional sites, either within the C-terminal helix itself or sites that directly influence its conformation, could also be reasonably targeted for mutations. Accordingly, through example 3, the present disclosure discloses methods to identify residues that could be modified or mutated to alter the substrate specificity of unmodified dioxygenase enzymes.

Example 4: Role of C-Terminal Helix in Catalysis

The purpose of Example 4 is to illustrate the importance of the C-terminal helix of the dioxygenase enzyme in substrate specificity as well as the rate of catalysis. As shown in Table 1, HPPD from rat and human are ~90% identical and yet, differ substantially in their catalytic ability using HPP or KIC as substrates. Human HPPD has lower activity with either substrate than the rat enzyme. To determine the role of C-terminus, the region corresponding to residues 361 to 393 (corresponding to the C-terminal domain) was swapped between the human and rat enzymes. Gene fragments corresponding to these residues were PCR-amplified and fused to create the swap. The resulting chimeric enzyme is the human HPPD with rat C-terminus (human-rC). The gene encoding the chimeric enzyme was cloned into pET28a expression vector, which was transformed into E. coli Rosetta cells. The cells were grown and activity of the purified enzyme assayed as described in Example 1.

Upon swapping the C-terminal domain of the human HPPD with that from rat, the activity of the chimeric enzyme decreased using HPP as the substrate but remained unchanged with KIC. The results shown in Table 2 are indicative of the importance of the role of the C-terminal domain in substrate specificity.

TABLE 2

| Enzyme activity | | |
|---|---|---|
| | Specific Activity | |
| Enzyme | HPP | KIC |
| Human (P32754) | 5.36 | 0.49 |
| Human-rC | 1.11 | 0.49 |

Example 5: Screening and Identification of Improved βHIV Enzymes

This example illustrates a methodology for identifying improved βHIV enzymes from a large number of variants. Starting with a Swissmodel homology model (https://swissmodel.expasy.org/repository/uniprot/P32755) which uses chain B of the PDB entry 3isq (human HPPD) as the template for rat HPPD, SHARPEN/CHOMP software was used (Loksha et al., Journal of Computational Chemistry, Volume 30 (6), 2009:999-1005). The script uses a Python module "smallmol" that extends or wraps OpenBabel, pybel, and the semi-empirical optimization software MOPAC and generated a 3D conformation of KIC from the SMILES format description of the molecule. The most promising structures obtained from MopacSuperScan, a customized code, were re-optimized without dihedral constraints. KIC and HMB were docked onto the catalytic iron by alignment of the keto acid to comparable ligand atoms found in multiple HPPD crystal structures. Each of these small molecule poses, along with the rat HPPD homology model, were used as input for a Rosetta protein design calculation. The amino acids selected for the enzyme active site were collated in Table 3.

strongly recommended mutating Phe371 to Leu. Given the Rosetta calculation results, combinatorial libraries were devised that could efficiently explore the space of mutations recommended by Rosetta, as well as by biophysical intuition about locations that could tolerate mutations and locations suitable to directly impact substrate specificity.

TABLE 4

Exemplary combinatorial library design

| site | degen codon | AA set | AA prob | native prob | num aa |
|------|-------------|--------|---------|-------------|--------|
| V212 | KTD | FLV | FLLVVV | 0.5 | 3 |
| L224 | HTG | LM | LLM | 0.666667 | 2 |
| Q251 | CMA | PQ | PQ | 0.5 | 2 |
| F364 | YKC | AFSV | AFSV | 0.25 | 4 |
| L367 | HTR | ILM | ILLLLM | 0.666667 | 3 |

TABLE 3

Permissive amino acid palette design calculations

185 TAVVTQTTTVTVTVVTVTVVVTTTVVTTVTVTTTQTTVTQ T, 0.525, V, 0.375,

187 TTATTNTTTTATTTTTTAATTTTTAAATTAATANATAAN T, 0.600, A, 0.325,

210 AAAAAAAAAAAAAAAAAAAAAAAAAAAAAAAAAAAAAAAA A, 1.000,

212 FFFFFFFFFFFWFFFFFFWFFFFFFFLHFFFFFWFFFFFF F, 0.875,

217 VVTVVVVVVVVTVIVVVVVVVVVVVVALVVVVVVVVVVVV V, 0.875,

224 LLYMLLAAMALFMMMMMAMLLLLMLLFLALLMAMWLLMLL L, 0.450, M, 0.300, A, 0.150,

226 VAAAVAVAVVAAAVVAAVAVVVAVVVVVAVVAVAAAAAAA A, 0.525, V, 0.475,

228 VVVVVVVVVVVVVVVVVVVVVVVVVVVVVVVVVVVVVVVV V, 0.975,

239 PPPPPAPPPPPPPPPPPPPPPPPPPPPPPPPPPPPPPPPP P, 0.975,

241 MMTMMAMMMTMTNMTTMMTTMMTMMTTMMMTTMTTTMTMA M, 0.525, T, 0.400,

251 PPWAPVPAPWMWPAIPAAMMPPPPPVWVPPIVPVMMPVMM P, 0.400, M, 0.175, V, 0.150, A, 0.125, W, 0.100,

252 MMVMMIMMMAAVMMAMMMIIMMMMMIVIMMIIMIVIMIVI M, 0.525, 1, 0.275, V, 0.125,

265 LFFLFFFLLFFFLLLLLFFFFFLFLFLLLLLFLFFLLFF F, 0.525, L, 0.475,

336 LLLALLLLALLLLLALLLLLLLLMLLMLLLALMLLLLLLL L, 0.825, A, 0.100,

347 HLLYLLLHFLLLFHFHYLLLLLLFLHLHHHFHLYLLHHLL L, 0.525, H, 0.275, F, 0.125,

359 FFFFFFFFFFFFFFFFFFFFFFFFFFFFFFFFFFFFFFFF F, 1.000,

364 AAAAAAAAAAAAGAAAAAAAAAAAGAAAAAAAAAAAA A, 0.950,

367 MMMLMMMMIMMMAMLMMMMMMMGMMMMMMLMMMMMMMMM M, 0.850,

368 TTTYTFFYFTTTFYFFYFFFTTTFTFTLFFFFFFYFTFTF F, 0.500, T, 0.350, Y, 0.125,

371 LFLLFLFLILFLLLILLFFFFFLFLLLLLILLLFFLLFF L, 0.550, F, 0.375,

Using the same approach, several additional rounds of Rosetta design calculations were performed. The library was gradually focused on a smaller number of residues that could more feasibly be sampled using medium throughput experimental assays. These were used, in combination with manual inspection of the enzyme models and biophysical intuition, to select combinatorial libraries for experimental synthesis. Rosetta suggested: avoiding mutations to Val 212, considering mutating Leu224 to Met, strongly recommended mutating Gln 251 to Pro, strongly recommended mutating Phe 364 to Ala, avoiding mutations to Leu 367, considering mutating Phe368 (to Tyr, His, or Leu), and TABLE 4-continued Exemplary combinatorial library design

| site | degen codon | AA set | AA prob | native prob | num aa |
|------|-------------|--------|---------|-------------|--------|
| F368 | YWC | FHLY | FHLY | 0.25 | 4 |
| F371 | HTC | FIL | FIL | 0.333333 | 3 |

DNA fragments comprising the degenerate codons were synthesized as Spread Out Low Diversity libraries by Twist Bioscience to intentionally retain the native residue at each selected locus and cloned into pET28a vector. The resulting ligation mixture was transformed into *E. coli* Rosetta cells and the colonies that appeared on selection plates were cultured in 96-well plates. After growth for 8 h and overnight induction, the cells were collected by centrifugation and lysed to obtain the cell-free extract. The cell-free extract comprising the active enzyme variant was used in an assay mixture (Johnson-Winters, Biochemistry, 2003, 42:2072-2080) in OxoPlates OP96U (Presens, Regensburg, Germany) to follow the reduction in dissolved oxygen. The calibrations and calculations were performed according to the manufacturer's instructions. Approximately 5400 variants were evaluated, and those with at least 90% of the wild-type activity with KIC and less than 50% of the wild-type activity with HPP were identified. Improved βHIV activity in the variants that were thus identified in the first screen was validated in triplicate assays and those that confirmed the improvement were sequenced to identify the mutations. Specific changes to five residues (V212L, L224M, Q251P, F368Y and F371L) emerged to be critical to increasing the enzyme activity with KIC while concomitantly reducing the activity with HPP.

Example 6: Evaluating the Catalytic Efficiency of the Variants

This example illustrates a method to quantify the catalytic efficiency of βHIV synthase enzymes and select improved variants. Exemplary βHIV synthase enzyme variants identified in Example 5 were produced in *E. coli* Rosetta cells and were purified from the lysates using Ni-NTA columns (Qiagen, Valencia, CA). The purified enzyme was assayed for activity using Oxythem oxygen electrode (Hansatech Instruments, Norfolk, UK) as described in Example 1. After initial observation of the nonenzymatic rate of oxygen consumption due to Fenton chemistry, the enzymatic reaction was initiated by the addition of different amounts of KIC or HPP. The kinetic constants were calculated by fitting the reaction velocity and the substrate concentration to Michaelis-Menten equation.

Some enzyme variants exhibited improved βHIV synthase activity, as shown in Table 5. The kinetic constants confirmed improved activity with KIC and concomitant reduction in activity with HPP.

TABLE 5

Exemplary βHIV synthase variants

| | | KIC | | | HPP | | |
|---|---|---|---|---|---|---|---|
| Mutant | Mutation | $k_{cat}$ [$s^{-1}$] | $K_M$ [mM] | $k_{cat}/K_M$ [$s^{-1}$ $M^{-1}$] | $k_{cat}$ [$s^{-1}$] | $K_M$ [mM] | $k_{cat}/K_M$ [$s^{-1}$ $M^{-1}$] |
| WT | — | 0.013 | 0.55 | 24 | 0.65 | 0.03 | 23214 |
| L | F371L | 0.008 | 0.14 | 53 | 0.10 | 0.04 | 2546 |
| PL | Q251P/F371L | 0.013 | 0.26 | 52 | 0.00 | 0.01 | 126 |
| LM | V212L/L224M | 0.014 | 0.13 | 114 | 0.05 | 0.03 | 1670 |

Example 7: Microbial Production of βHIV

This example illustrates the production of βHIV in bacteria and yeast. A strain of *Corynebacterium glutamicum* MV-KICF1 (Applied Microbiol, Microb Biotech, 8, 351-360) that was metabolically modified to produce α-ketoisocaproate was used to introduce a gene that encodes for a polypeptide encoding SEQ ID NO: 1. The codons in the nucleic acid sequence of the gene were optimized according to the codon usage of the bacterium and the DNA was cloned into pZ8-ptac vector (Cleto et al., ACS Synth Biol. 2016 May 20; 5 (5): 375-385) and transformed into MV-KICF1 by electroporation. The non-natural bacterial strain endowed with the capability to produce βHIV was propagated in Brain-Heart Infusion medium and cultivated in CGXII medium (Hoffman et al., J Appl Microbiol., 2014, 117:663-678) using glucose as the main carbon source to evaluate the βHIV production. Substrate consumption and product formation was evaluated on Agilent 1200 HPLC using 5 mM $H_2SO_4$ as the mobile phase with Aminex HPX-87c column (BioRad, Hercules, CA). As illustrated in FIG. 6, the non-natural bacterium comprising βHIV synthase produced more βHIV than its parent wild-type.

As an example of βHIV production using eukaryotes, a non-natural strain of yeast called SB553 comprising of an active βHIV metabolic pathway was used. This strain of yeast, derived from Y-5396, was further modified by integrating codon-optimized genes that encode for different wildtype βHIV synthase (Seq ID NO: 1) or its PL variant (Q251P/F371L) on the chromosome using homologous recombination, resulting in strains SB556 and SB557, respectively. The strains were grown in 50 mL of yeast minimal salts medium supplemented with uracil, trace metals, vitamins and glucose as the carbon source (Verduyn, et al., Yeast 8, 7:501-517, 1992). After 36 h of growth, the yeast culture was harvested and centrifuged to remove the yeast cells. The clarified supernatants were analyzed for residual glucose and βHIV synthesis via HPLC (Aminex HPX-87h column, 5 mM H2SO4 as the eluent at 1 mL/min and RI detector). As illustrated in FIG. 7, SB556 produced only 0.04 g/L of βHIV and SB557 produced 0.12 g/L of βHIV. The results suggested that an improved βHIV synthase variant can facilitate increased production of βHIV.

Example 8: Directed Evolution of Enzymes for Improved βHIV Activity

The activity of βHIV synthase could be further improved by directed evolution. This example illustrates a method of improving βHIV synthase activity using such methods. The general outline of the method is described in Chen, Directed Evolution of Cytochrome P450 for Small Alkane Hydroxylation. 2011. California Institute of Technology, PhD dissertation. Hundreds of βHIV synthase variant genes are synthesized by Twist Biosciences as a spread out low diversity library. DNA fragments containing the diversity are Gibson-assembled into pET28a+ plasmid as in Example 5. The pooled variants are transformed into *E. coli* Rosetta cells and plated. As described in Example 5, the picked colonies will be arrayed into deep well 96 plates for growth in Luria Bertani broth containing the necessary antibiotics. The optical assay described in Example 5 is used to identify enzyme variants that consume oxygen more rapidly in the presence of KIC. Variants with improved activity relative to parent sequences are retested and validated. Variants with statistically significant improved activity are sequenced. Favorable mutations identified during the screening are combined using gene recombination and the process is repeated where a new library of βHIV synthase variants are generated using random mutagenesis (error prone PCR).

Various embodiments of systems, devices, and methods have been described herein. These embodiments are given only by way of example and are not intended to limit the scope of the claimed inventions. It should be appreciated, moreover, that the various features of the embodiments that have been described may be combined in various ways to produce numerous additional embodiments. Moreover, while various materials, dimensions, shapes, configurations and locations, etc. have been described for use with disclosed embodiments, others besides those disclosed may be utilized without exceeding the scope of the claimed inventions.

Persons of ordinary skill in the relevant arts will recognize that the subject matter hereof may comprise fewer features than illustrated in any individual embodiment described above. The embodiments described herein are not meant to be an exhaustive presentation of the ways in which the various features of the subject matter hereof may be combined. Accordingly, the embodiments are not mutually exclusive combinations of features; rather, the various embodiments can comprise a combination of different individual features selected from different individual embodiments, as understood by persons of ordinary skill in the art. Moreover, elements described with respect to one embodiment can be implemented in other embodiments even when not described in such embodiments unless otherwise noted.

Although a dependent claim may refer in the claims to a specific combination with one or more other claims, other embodiments can also include a combination of the dependent claim with the subject matter of each other dependent claim or a combination of one or more features with other dependent or independent claims. Such combinations are proposed herein unless it is stated that a specific combination is not intended.

Any incorporation by reference of documents above is limited such that no subject matter is incorporated that is contrary to the explicit disclosure herein. Any incorporation by reference of documents above is further limited such that no claims included in the documents are incorporated by reference herein. Any incorporation by reference of documents above is yet further limited such that any definitions provided in the documents are not incorporated by reference herein unless expressly included herein.

For purposes of interpreting the claims, it is expressly intended that the provisions of 35 U.S.C. § 112 (f) are not to be invoked unless the specific terms "means for" or "step for" are recited in a claim.

SEQUENCE LISTING (296 sequences)

SEQ ID NO: 1 - protein, 393 aa, Rattus norvegicus
MTTYSNKGPKPERGRFLHFHSVTFWVGNAKQAASFYCNKMGFEPLAYKGLETGSREVVSHVIKQGKIVFVLCSALNPWNKEMGDHLVKHGDGVKDIAFEVEDCEHIVQKARERGAKIVREPWVEEDKFGKVKFAVLQTYGDTTHTLVEKINYTGRFLPGFEAPTYKDTLLPKLPSCNLEIIDHIVGNQPDQEMESASEWYLKNLQFHRFWSVDDTQVHTEYSSLRSIVVANYEESIKMPINEPAPGRKKSQIQEYVDYNGGAGVQHIALRTEDIITTIRHLRERGMEFLAVPSSYYRLLRENLKTSKIQVKENMDVLEELKILVDYDEKGYLLQIFTKPMQDRPTLFLEVIQRHNHQGFGAGNFNSLFKAFEEEQALRGNLTDLETNGVRSGM

SEQ ID NO: 2 - protein, 377 aa, Rattus norvegicus
MYWDKGPKPERGRFLHFHSVTFWVGNAKQAASFYCNKMGFEPLAYKGLETGSREVVSHVIKQGKIVFVLCSALNPWNKEMGDHLVKHGDGVKDIAFEVEDCEHIVQKARERGAKIVREPWVEEDKFGKVKFAVLQTYGDTTHTLVEKINYTGRFLPGFEAPTYKDTLLPKLPSCNLEIIDHIVGNQPDQEMESASEWYLKNLQFHRFWSVDDTQVHTEYSSLRSIVVANYEESIKMPINEPAPGRKKSQIQEYVDYNGGAGVQHIALRTEDIITTIRHLRERGMEFLAVPSSYYRLLRENLKTSKIQVKENMDVLEELKILVDYDEKGYLLQIFTKPMQDRPTLFLEVIQRHNHQGFGAGNFNSLFKAFEEEQALRG

SEQ ID NO: 3 - protein, 354 aa, Rattus norvegicus
MGFEPLAYKGLETGSREVVSHVIKQGKIVFVLCSALNPWNKEMGDHLVKHGDGVKDIAFEVEDCEHIVQKARERGAKIVREPWVEEDKFGKVKFAVLQTYGDTTHTLVEKINYTGRFLPGFEAPRYKDTLLPKLPSCNLEIIDHIVGNQPDQEMESASEWYLKNLQFHRFWSVDDTQVHTEYSSLRSIVVANYEESIKMPINEPAPGRKKSQIQEYVDYNGGAGVQHIALRTEDIITTIRHLRERGMEFLAVPPSYYRLLRENLKSAKIQVKEDMDVLEELKILVDYDEKGYLLQIFTKPMQDRPTLFLEVIQRHNHQGFGAGNFNSLFKAFEEEQALRGNLTDLETNGVRSGM

SEQ ID NO: 4 - protein, 394 aa, Yarrowia lipolytica
MSPSVEVTPAHTPTSYEVTNSLDSYRGYDHVHWYVGNAKQAASFYITRMGFSPIAYKGLETGSRDVTTHVVGNGQVRFAFSSALRTGEPQADEIHAHLVKHGDAVKDVAFEVDNVEQLFSAAVKKGVRVISEPKVLKDAHGSVTYAVISTYGDTTHTLIERGSYEGAFLPGFVDTSANKDPIAAFLPNIELMHIDHCVGNQDWNEMDNACKYYEETLGFHRFWSVDDKDICTEFSALKSVVMASPNEKIKMPVNEPAVGKKKSQIEEYIDFYDGPGIQHIALRTDCILDTVRDLRARGVEFISVPGSYYENMKERLAKSSLKLEEKFEDIQALNILIDFDEGGYLLQLFTKPLMDRPTVFIEIIQRRNFEGFGAGNFKSLFEAIEREQAKRGNL

SEQ ID NO: 5 - protein, 394 aa, Yarrowia lipolytica
MSPSVEVTPAHTPTSYEVTNSLDSYRGYDHVHWYVGNAKQAASFYITRMGFSPIAYKGLETGSRDVTTHVVGNGQVRFAFSSALRTGEPQADEIHAHLVKHGDAVKDVAFEVDNVEQLFSAAVKKGVRVISEPKVLKDAQGSVTYAVISTYGDTTHTLIERGSYEGAFLPGFVDTSANKDPIAAFLPNIELMHIDHCVGNQDWNEMDNACKYYEETLGFHRFWSVDDKDICTEFSALKSVVMASPNEKIKMPVNEPAVGKKKSQIEEYIDFYDGPGIQHIALRTDCILDTVRDLRARGVEFISVPGSYYENMKERLAKSSLKLEEKFEDIQALNILIDFDEGGYLLQLFTKPLMDRPTVFIEIIQRRNFEGFGAGNFKSLFEAIEREQAKRGNL

SEQ ID NO: 6 - protein, 393 aa, Homo sapiens
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIMREPWVEQDKFGKVKFAVLQTYGDTTHTLVEKMNYIGQFLPGYEAPAFMDPLLPKLPKCSLEMIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYKQLREKLKTAKIKVKENIDALEELKILVDYDEKGYLLQIFTKPVQDRPTLFLEVIQRHNHQGFGAGNFNSLFKAFEEEQNLRGNLTNMETNGVVPGM

SEQ ID NO: 7 - protein, 377 aa, Homo sapiens
WYWDKGPKPERGRFLHFHSVTFWVGNAKQAASFYCNKMGFEPLAYKGLETGSREVVSHVVKQGKIVFVLCSALNPWNKEMGDHLVKHGDGVKDIAFEVEDCEHIVQKARERGAKIVREPWVEEDKFGKVKFAVLQTYGDTTHTLVEKINYTGRFLPGFEAPTYKDTLLPKLPSCNLEIIDHIVGNQPDQEMESASEWYLKNLQFHRFWSVDDTQVHTEYSSLRSIVVANYEESIKMPINEPAPGRKKSQIQEYVDYNGGAGVQHIALRTEDIITTICHLRERGMEFLAVPSSYYRLLRENLKTSKIQVKENMDVLEELKILVDYDEKGYLLQIFTKPMQDRPTLFLEVIQRHNHQGFGAGNFNSLFKAFEEEQALRG

SEQ ID NO: 8 - protein, 375 aa, Homo sapiens [sequence omitted]

SEQ ID NO: 9 - protein, 376 aa, Rattus norvegicus
YWDKGPKPERGRFLHFHSVTFWVGNAKQAASFYCNKMGFEPLAYKGLETGSREVVSHVIKQGKIVFVLCSALNPWNKEMGDHLVKHGDGVKDIAFEVEDCEHIVQKARERGAKIVREPWVEEDKFGKVKFAVLQTYGDTTHTLVEKINYTGRFLPGFEAPTYKDTLLPKLPSCNLEIIDHIVGNQPDQEMESASEWYLKNLQFHRFWSVDDTQVHTEYSSLRSIVVANYEESIKMPINEPAPGRKKSQIQEYVDYNGGAGVQHIALRTEDIITTIRHLRERGMEFLAVPSSYYRLLRENLKTSKIQVKENMDVLEELKILVDYDEKGYLLQIFTKPMQDRPTLFLEVIQRHNHQGFGAGNFNSLFKAFEEEQALRG

SEQ ID NO: 10 - protein, 393 aa, Mus musculus domesticus
MTTYNNKGPKPERGRFLHFHSVTFWVGNAKQAASFYCNKMGFEPLAYRGLETGSREVVSHVIKRGKIVFVLCSALNPWNKEMGDHLVKHGDGVKDIAFEVEDCDHIVQKARERGAKIVREPWVEQDKFGKVKFAVLQTYGDTTHTLVEKINYTGRFLPGFEAPTYKDTLLPKLPRCNLEIIDHIVGNQPDQEMQSASEWYLKNLQFHRFWSVDDTQVHTEYSSLRSIVVTNYEESIKMPINEPAPGRKKSQIQEYVDYNGGAGVQHIALKTEDIITAIRHLRERGTEFLAAPSSYYKLLRENLKSAKIQVKESMDVLEELHILVDYDEKGYLLQIFTKPMQDRPTLFLEVIQRHNHQGFGAGNFNSLFKAFEEEQALRGNLTDLEPNGVRSGM

SEQ ID NO: 11 - protein, 379 aa, Mus musculus
TVDYWDKGPKPERGRFLHFHSVTFWVGNAKQAASFYCNKMGFEPLAYRGLETGSREVVSHVIKQGKIVFVLCSALNPWNKEMGDHLVKHGDGVKDIAFEVEDCNHIVQKARERGAKIVRDAWVEQDKFGKVKFAVLQTYGDTTHTLVEKINYTGRFLPGFEAPTYKDTLLPKLPRCNLEIIDHIVGNQPDQEMQSASEWYLKNLQFHRFWSVDDTQVHTEYSSLRSIVVTNYEESIKMPINEPAPGRKKSQIQEYVDYNGGAGVQHIALKTEDIITAIRHLRERGTEFLAAPSSYYKLLRENLKSAKIQVKESMDVLEELHILVDYDEKGYLLQIFTKPMQDRPTLFLEVIQRHNHQGFGAGNFNSLFKAFEEEQALRG

SEQ ID NO: 12 - protein, 393 aa, Homo sapiens [sequence omitted]

SEQ ID NO: 13 - protein, 393 aa, Rattus norvegicus; identical to SEQ ID NO: 1

SEQ ID NO: 14 - protein, 393 aa, Mus musculus
MTTYNNKGPKPERGRFLHFHSVTFWVGNAKQAASFYCNKMGFEPLAYRGLETGSREVVSHVIKQGKIVFVLCSALNPWNKEMGDHLVKHGDGVKDIAFEVEDCDHIVQKARERGAKIVREPWVEQDKFGKVKFAVLQTYGDTTHTLVEKINYTGRFLPGFEAPTYKDTLLPKLPRCNLEIIDHIVGNQPDQEMQSASEWYLKNLQFHRFWSVDDTQVHTEYSSLRSIVVTNYEESIKMPINEPAPGRKKSQIQEYVDYNGGAGVQHIALKTEDIITAIRHLRERGTEFLAAPSSYYKLLRENLKSAKIQVKESMDVLEELHILVDYDEKGYLLQIFTKPMQDRPTLFLEVIQRHNHQGFGAGNFNSLFKAFEEEQALRGNLTDLEPNGVRSGM

SEQ ID NO: 15 - protein, 393 aa, Bos taurus
MTTYSDKGEKPERGRFLHFHSVTFWVGNAKQAASYYCSKLGFEPLAYKGLETGSREVVSHVVKQGQIVFVFSSALNPWNKEMGDHLVKHGDGVKDIAFEVEDCDYIVQKARERGAKIVREPWVEQDKLGKVKFAVLQTYGDTTHTLVEKMNYTGRFLPGFEAPPFMDPQLSKLPSCSLEIIDHIVGNQPDQEMVSASEWYLKNLQFHRFWSVDDTQVHTEYSSLRSVVVANYEESIKMPINEPAPGKKKSQIQEYVDYNGGAGVQHIALKTKDIITAIRHLRERGVEFLAVPSTYYKQLREKLKMAKIRVKENIDILEELKILVDYDEKGYLLQIFTKPMQDRPTLFLEVIQRHNHQGFGAGNFNSLFKAFEEEQDLRGNLTDMEPNGVVSGM

SEQ ID NO: 16 - protein, 393 aa, Mus musculus
MTTYNNKGPKPERGRFLHFHSVTFWVGNAKQAASFYCNKMGFEPLAYRGLETGSREVVSHVIKQGKIVFVLCSALNPWNKEMGDHLVKHGDGVKDIAFEVEDCDHIVQKARERGAKIVREPWVEQDKFGKVKFAVLQTYGDTTHTLVEKINYTGRFLPGFEAPTYKDTLLPKLPRCNLEIIDHIVGNQPDQEMQSASEWYLKNLQSHRFWSVDDTQVHTEYSSLRSIVVTNYEESIKMPINEPAPGRKKSQIQEYVDYNGGAGVQHIALKTEDIITAIRHLRERGTEFLAAPSSYYKLLRENLKSAKIQVKESMDVLEELHILVDYDEKGYLLQIFTKPMQDRPTLFLEVIQRHNHQGFGAGNFNSLFKAFEEEQALRGNLTDLEPNGVRSGM

SEQ ID NO: 17 - protein, 377 aa, Homo sapiens; identical to SEQ ID NO: 7

SEQ ID NO: 18 - protein, 393 aa, Pan troglodytes
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIVREPWVEQDKFGKVKFAVLQTYGDTTHTLVEKMNYIGQFLPGYEAPAFMDPLLPKLPKCSLEMIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYKQLREKLKTAKIKVKENIDALEELKILVDYDEKGYLLQIFTKPVQDRPTLFLEVIQRHNHQGFGAGNFNSLFKAFEEEQNLRGNLTNMETNGVVPGM

SEQ ID NO: 19 - protein, 393 aa, Cricetulus griseus
MTTYTNKGPKPERGRFLHFHSVTFWVGNAKQAASFYCNKMGFEPLAYRGLETGSREVVSHVIKQGKIVFVFCSALNPWNKEMGDHLVKHGDGVKDIAFEVEDCDHIVQKARERGAKIVREPWVEEDKFGKVKFAVLQTYGDTTHTLVEKINYTGRFLPGFEAPTYKDTLLPKLPRCNLEIIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITTIRHLRERGMEFLAVPSSYYKLLRENLKTAKIQVKESLDVLEELKILVDYDEKGYLLQIFTKPMQDRPTLFLEVIQRRNHQGFGAGNFNSLFKAFEEEQALRGNLTDMETNGVRSGM

SEQ ID NO: 20 - protein, 393 aa, Saimiri boliviensis boliviensis
MTTYSDKGAKPERGRFLHFHSVTFWVGNAKQAASFYCTKMGFEPLAYRGLETGSREVVSHVIKQGKIVFVLSSALNPWNKEMGNHLVKHGDGVKDIAFEVEDCDYIVQKARERGAKIVREPWVEEDKFGKVKFAVLQTYGDTTHTLVEKMSYAGRFLPGYEAPAFMDPLLPQLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLRERGMEFLSVPSTYYKQLREKLKVAKIKVKESIDVLEELKILVDYDEKGYLLQIFTKPVQDRPTLFLEVIQRHNHQGFGAGNFNSLFKAFEEEQNLRGNLTNMETDGVVPGM

SEQ ID NO: 21 - protein, 393 aa, Felis catus
MTTYSNKGEKPARGRFLHFHSVTFWVGNAKQAASFYCNKMGFEPLAYKGLETGSREVVSHVIKQGKIVFVFSSALNPWNKEMGDHLVKHGDGVKDIAFEVEDCDYIAQKARERGAKIVREPWIEQDKFGKVKLAVLQTYGDTTHTLVEKMNYTGRFLPGFEAPAFVDPLLSKLPSCSLEIIDHIVGNQPDQEMESASDWYLKNLQFHRFWSVDDTQVHTEYSSLRSIVVANYEESIKMPINEPAPGKKKSQIQEYVDYNGGPGVQHIALKTQDIITAIRHLRERGMEFLGVPSTYYKQLREKLKSAKIRVKENIDVLEELKILVDYDEKGYLLQIFTKPVQDRPTLFLEVIQRHNHQGFGAGNFNSLFKAFEEEQNLRGNLTDLENNGIVPGM

SEQ ID NO: 22 - protein, 393 aa, Ovis aries
MTTYSDKGEKPERGRFLHFHSVTFWVGNAKQAASYYCSKLGFEPLAYKGLETGSREVVSHVVKQGQIVFIFSSALNPWNKEMGDHLVKHGDGVKDIAFEVEDCDYIVQKARERGAKIVREPWVEQDKLGKVKFAVLQTYGDTTHTLVEKMNYTGRFLPGFEAPAFMDPQLSKLPNCGLEIIDHIVGNQPDQEMVSASEWYLKNLQFHRFWSVDDTQVHTEYSSLRSIVVANYEESIKMPINEPAPGKKKSQIQEYVDYNGGAGVQHIALKTKDIITAIRHLRERGVEFLAVPSTYYKQLREKLKSAKIRVKENIDILEELKILVDYDEKGYLLQIFTKPMQDRPTLFLEVIQRHNHQGFGAGNFNSLFKAFEEEQDLRGNLTDMEPNGVVSSM

SEQ ID NO: 23 - protein, 393 aa, Orcinus orca
MTTYSNKGEKPERGRFLHFHSVTFWVGNAKQAASYYCSKMGFESLAYKGLETGSRETVSHVIKQGKIVFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPAFVDPLLPKLPNCSLERIDHIVGNQPDQEMLSASEWYLKNLQFHRFWSVDDTQVHTEYSSLRSIVVANYEESIKMPINEPAPGRKKSQIQEYVDYNGGAGVQHIALKTEDIITAIRHLRERGMEFLAVPSTYYKQLREKLKSAKIRVKENIDVLEELKILVDYDEKGYLLQIFTKPMQDRPTLFLEVIQRYNHQGFGAGNFNSLFKAFEEEQDLRGNLTDMETNGTVPSM

SEQ ID NO: 24 - protein, 393 aa, Odobenus rosmarus divergens
MTTYSDKGRKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEQDKFGKVKLAVLQTYGDTTHTLVEKMNYSGWFLPGFETPASVDPLLSKLPTCSLEIIDHIVGNQPDQEMVSASEWYLKNLQFHRFWSVDDTQVHTEYSSLRSIVVANFEESIKMPINEPAPGKKKSQIQEYVDYNGGAGVQHIALKTQDIITAIRHLRERGMEFLAVPPTYYKQLREKLKSAKIRVKESIDILEELKILVDYDEKGYLLQIFTKPMQDRPTLFLEVIQRHNHQGFGAGNFNSLFKAFEEEQDLRGNLTDLKNTRTLPGM

SEQ ID NO: 25 - protein, 393 aa, Dasypus novemcinctus
MTTYSDKGVKPERGRFLHFHSVTFWVGNAKQAASFYCNKMGFEPLAYRGLETGSREVVSHVVKQDKIVFVLSSALNPGNKEMGDHLVKHGDGVKDIAFEVEDCASIVQKARERGAKIVREPWVEEDKFGKVKFAVLQTYGDTTHTLVEKMNYTGRFLPGFEAPVITDPLLAKLPSCRLEIIDHIVGNQPDQEMVSASEWYVKNLQFHRFWSVDDTQVHTEYSSLRSIVVANYEETIKMPINEPAQGKKKSQIQEYVDYNGGAGVQHIALKTQDIITAIRHLKERGLEFLAVPSTYYRQLREKLKTAKIKVKESIDILEELKILVDFDEKGYLLQIFTKPVQDRPTLFLEVIQRHNHQGFGAGNFNSLFKAFEEEQKLRGNLTDLGANGVLPGM

SEQ ID NO: 26 - protein, 393 aa, Jaculus jaculus
MTTYSDKGPKPERGRFLHFHSVTFWVGNAKQAASFYCNKMGFEPLAYKGLETGSREVVSHVIKQGKIVFVLSSALNPWNKEMGDHLVKHGDGVKDIAFEVEDCEHIVQKARERGAKIVREPWVEQDRFGKVKFAVLQTYGDTTHTLVEKINYTGRFLPGFEAPMLKDPLLSKLPNCSLEIIDHIVGNQPDQEMESASEWYLKNLQFHRFWSVDDTQVHTEYSSLRSIVVANYEESIKMPINEPAPGKKKSQIQEYVDYNGGAGVQHIALKTQDIITTIRHLRERGMEFLAVPSTYYKLLRENLKSAKIRVKESIDVLEELKILVDYDENGYLLQIFTKPMQDRPTLFLEVIQRHNHQGFGAGNFNSLFKAFEEEQALRGNLTDMETNGVVSGM

SEQ ID NO: 27 - protein, 393 aa, Mustela putorius furo
MTTYSDKGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYLVQKAREQGAKIVREPWIEQDKFGKVKLAVLQTYGDTTHTLVEKMNYTGRFLPGFEAPISVDPLLSKLPTCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLKARGMEFLGVPSSYYKQLREKLKTAKIQVKENIDVLEELKILVDYDEKGYLLQIFTKPMQDRPTLFLEVIQRHNHQGFGAGNFNALFKAFEEEQDLRGNLTNLETNSSLRGM

SEQ ID NO: 28 - protein, 393 aa, Heterocephalus glaber
MTTYSDKGAKPERGRFLHFHSVTFWVGNAKQAAAFYCSKMGFEPLAYRGLETGSREVASHVIKQGQIVFVLSSPLNPWNREMGEHLVKHGDSVKDIAFEVEDCDYIVQKARERGAKVVREPWVEEDKFGKVKLAVLQTYGDTTHTLVEKMSFSGSFLPGFEAPRVKDSLLSKLPSCGLETIDHIVGNQPDQEMVSASEWYLRNLQFHRFWSVDDSQVHTEYSALRSIVVTNYEESIKMPINEPALGRKKSQIQEYVEYNGGAGVQHIALKTPDIITSIRHLRERGVEFLAVPSTYYKQLRENLKSAKIRVKESIDMLEELKILVDYDEKGYLLQVFTKPVQDRPTLFLEVIQRHNHQGFGAGNFNALFKAFEAEQDLRGNLTDTETNGVVSGV

SEQ ID NO: 29 - protein, 393 aa, Microtus ochrogaster
MTTYTNKGPKPERGRFLHFHSVTFWVGNAKQAASFYCNKMGFEPLAYKGLETGSREVVSHVIKQGKIVFVLCSALNPWNKEMGDHLVKHGDGVKDIAFEVEDCEHIVQKARERGAKIVREPWVEEDKFGKVKFAVLQTYGDTTHTLVEKINYTGHFLPGFEAPVYKDTLLPKLPRCNLEVIDHIVGNQPDQEMVSASEWYLKNLQFHRFWSVDDTQVHTEYSSLRSIVVANYEESIKMPINEPAPGKKKSQIQEYVDYNGGAGVQHIALKTDDIITAIHHLRERGMEFLAVPSSYYKLLRENLKTAKIQVKESMDTLEELKILVDYDEKGYLLQIFTKPMQDRPTLFLEVIQRHNHQGFGAGNFNSLFKAFEEEQALRGNLTDLETNGVRSGK

SEQ ID NO: 30 - protein, 393 aa, Chinchilla lanigera
MTTYSDKGAKPERGRFLHFHSVTFWVGNAKQAASFYCSKMGFEPLAYRGLETGSREVASHVIKQGQIVFVFSSPLNPWNKEMGDHLVKHGDGVKDIAFEVEDCDYIVQKARERGAKVVREPWVEQDKSGKVKFAVLQTYGDTTHTLVEKTGYSGSFLPGFEAARAKDSLLSKLPSCGLEIIDHIVGNQPDQEMLSASEWYLRNLQFHRFWSVDDTQVHTEYSSLRSIVVTDYEESIKMPINEPAPGKKKSQIQEYVDYNGGAGVQHIALKTQDIITAIRHLRERGAEFLAVPSSYYTQLRENLKSAKVRVKENIDVLEELKILVDYDEKGYLLQIFTKPMQDRPTLFLEVIQRHNHQGFGAGNFNALFKAFEAEQDLRGNLTDLETNGVASGM

SEQ ID NO: 31 - protein, 393 aa, Macaca fascicularis
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKAREQGAKIVREPWVEQDKFGKVKFAVLQTYGDTTHTLVEKMNYTGQFLPGYEAPVFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITTIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLTDLETNGVVPGM

SEQ ID NO: 32 - protein, 393 aa, Equus caballus
MTTYSNKGEKPEKGRFLHFHSVTFWVGNAKQAASFYCNKLGFEPLAYKGLETGSREVVSHVIKQGKIIFVFSSALNPWNKEMGDHLVKHGDGVKDIAFEVEDCDYIVQKARERGAKIVREPWVEQDKFGKVKFAVLQTYGDTTHTLVEKMSYAGRFLPGFEAPAFRDPLLSKLPNCSLEIIDHVVGNQPDHEMESASEWYLKNLQFHRFWSVDDTQVHTEYSSLRSIVVANYEESIKMPINEPAPGRKKSQIQEYVDYNGGAGVQHIALKTHDIITAIRHLRERGMEFLAVPSSYYRQLQEKLKSAKIRVKESIDVLEELKILVDYDEKGYLLQIFTKPTQDRPTLFLEVIQRHNHQGFGAGNFNALFKAFEEEQDLRGNLTDMQTNDLVPGK

SEQ ID NO: 33 - protein, 393 aa, Bos mutus
MTTYSDKGEKPERGRFLHFHSVTFWVGNAKQAASYYCSKLGFEPLAYKGLETGSREVVSHVVKQGQIVFVFSSALNPWNKEMGDHLVKHGDGVKDIAFEVEDCDYIVQKARERGAKIVREPWVEQDKLGKVKFAVLQTYGDTTHTLVEKMNYTGRFLPGFEAPPFMDPQLSKLPSCSLEIIDHIVGNQPDQEMVSASEWYLKNLQFHRFWSVDDTQVHTEYSSLRSVVVANYEESIKMPINEPAPGKKKSQIQEYVDYNGGAGVQHIALKTKDIITAIRHLRERGVEFLAVPSTYYKQLREKLKMAKIRVKENIDILEELKILVDYDEKGYLLQIFTKPMQDRTTIFLEVIQRHNHQGFGAGNFNSLFKAFEEEQDLRGNLTDMEPNGVVSGM

SEQ ID NO: 34 - protein, 390 aa, Vicugna pacos
MTTYSNKGEKPERGRFLHFHSVTFWVGNAKQAASYYCSKMGFEPLAYKGLETRSREVVSHVIKQGKIVFVFSSALNPWNKEMGDHLVKHGDGVKDIAFEVEDCDYIVQKARERGAKIVREPWVEQDKFGKVKFAVLQTYGDTTHTLVEKMNYTGRFLPGFEAPASTDPLLSKLPNCGLEIIDHIVGNQPDQEMLSASEWYLKNLQFHRFWSVDDTQVHTEYSSLRSIVVANYEESIKMPINEPAPGRKKSQIQEYVDYNGGAGVQHIALKTQDIITAIRHLRERGMEFLAVPSTYYKQLREKLKSAKIRVKENIDVLEELKILVDYDEKGYLLQIFTKPMQDRPTLFLEVIQRHNHQGFGAGNFNSLFKAFEEEQDLRGNLTDMETSGVV

SEQ ID NO: 35 - protein, 393 aa, Myotis davidii
MTSYSNKGEKPERGRFLHFHSVTFWVGNAKQAASFYCSKMGFKPIAYKGLETGSREVVSHVVKQGQIVFVFSSALNPWNKEMGDHLVKHGDGVKDIAFEVEDCDYIVQKARQRGAKIIREPWVEQDKFGKVKFAVLQTYGDTTHTLVEKMNYAGFFLPGFEPTTNRDQALSKLPQSNLEVIDHIVGNQPDQEMLSASDWYLNNLQFHRFWSVDDTQVHTEYSSLRSIVVANYEESIKMPINEPAPGRKKSQIQEYVDYNGGAGVQHIALKTQDIITAIRHLRERGMEFLDVPSTYYKQLREKLKSAKIRVKENLDALEELKILVDYDENGYLLQIFTKPMQDRPTLFLEVIQRHNHQGFGAGNFNALFKAFEEEQNMRGNLTDLEPNGVIRGM

SEQ ID NO: 36 - protein, 393 aa, Leptonychotes weddellii
MTTYSDKGKKPQRGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEQDKFGKVKLAVLQTYGDTTHTLVEKMNYSGRFLPGFETPASVDPLLSKLPSCSLEMIDHIVGNQPDQEMVSASEWYLKNLQFHRFWSVDDTQVHTEYSSLRSIVVANFEESIKMPINEPAPGKKKSQIQEYVDYNGGAGVQHIALKTQDIITAIRHLRERGMEFLAVPPMYYKQLREKLKSAKIRVKESIDTLEELKILVDYDEKGYLLQIFTKPMQDRPTLFLEVIQRHNHQGFGAGNFNSLFKAFEEEQDLRGNLTDLENTRTLPGM

SEQ ID NO: 37 - protein, 393 aa, Peromyscus maniculatus bairdii
MTSYTNKGPKPERGRFLHFHSVTFWVGNAKQAASFYCNKMGFEPLAYKGLETGSREVVSHVIKQGKIVFVLSSALNPWNKEMGDHLVKHGDGVKDIAFEVEDCEHIVQKARERGAKIVREPWVEQDKFGKVKFAVLQTYGDTTHTLVEKINYTGRFLPGFEAPMHKDTLLSKLPSCNLEVIDHIVGNQPDQEMLSASEWYLKNLQFHRFWSVDDTQVHTEYSSLRSIVVANYEESIKMPINEPAPGKKKSQIQEYVDYNGGAGVQHIALKTEDIITTIRHLRERGMEFLAVPSSYYRLLRENLKTAKIQVKESMDVLEELKILVDYDEKGYLLQIFTKPMQDRPTLFLEVIQRHNHQGFGAGNFNSLFKAFEEEQALRGNLTDLETNGVRSGM

SEQ ID NO: 38 - protein, 393 aa, Panthera tigris altaica
MTTYSNKGEKPARGRFLHFHSVTFWVGNAKQAASFYCNKMGFEPLAYKGLETGSREVVSHAIKQGKIVFVFSSALNPWNKEMGDHLVKHGDGVKDIAFEVEDCDYIVQKARERGAKIVREPWIEQDKFGKVKLAVLQTYGDTTHTLVEKMNYTGRFLPGFEAPAFVDPLLSKLPSCSLEIIDHIVGNQPDQEMESASDWYLKNLQFHRFWSVDDTQVHTEYSSLRSIVVANYEESIKMPINEPAPGKKKSQIQEYVDYNGGPGVQHIALKTQDIITAIRHLRERGMEFLGVPSTYYKQLREKLKSAKIRVKENIDVLEELKILVDYDEKGYLLQIFTKPVQDRPTLSLEVIQRHKHQGFGAGNFNSLFKAFEEEQNLRGNLTDLENNGIVPGM

SEQ ID NO: 39 - protein, 393 aa, Physeter catodon
MTTYSNKGEKPERGQFLHFHSVTFWVGNAKQAASYYCSKMGFEPLAYKGLETGSREMVSHVIKQGKIVFIFSSALNPWNKEMGDHLVKHGDGVKDIAFEVEDCDYIVQKARERGAKIVREPWVEQDKFGRVKFAVLQTYGDTTHTLVEKMNYTGWFLPGFEAPAFVDPLLSKLPNCSLEIIDHIVGNQPDQEMVSASEWYLKNLQFHRFWSVDDTQVHTEYSSLRSIVVANYEESIKMPINEPAPGRKKSQIQEYVDYNGGAGVQHIALKTEDIITAIRHLRERGMEFLAVPFTYYKQLREKLKSAKIRVKENIDVLEELKILVDYDEKGYLLQIFTKPMQDRPTLFLEVIQRYNHQGFGAGNFNSLFKAFEEEQDLRGNLTDMETNGVGSGM

SEQ ID NO: 40 - protein, 393 aa, Bubalus bubalis
MTTYSDKGEKPERGRFLHFHSVTFWVGNAKQAASYYCSKLGFEPLAYKGLETGSREVVSHVVKQGQIVFVFSSALNPWNKEMGDHLVKHGDGVKDIAFEVEDCDYIVQKARERGAKIVREPWVEQDKLGKVKFAVLQTYGDTTHTLVEKMNYTGRFLPGFEAPPFMDPQLSKLPSCSLEIIDHIVGNQPDQEMVSASEWYLKNLQFHRFWSVDDTQVHTEYSSLRSVVVANYEESIKMPINEPAPGKKKSQIQEYVDYNGGAGVQHIALKTKDIITAIRHLRERGVEFLAVPSTYYKQLREKLKSAKIRVKENIDILEELKILVDYDEKGYLLQIFTKPMQDRPTLFLEVIQRHNHQGFGAGNFNSLFKAFEEEQDLRGNLTDMEPNGVVSGM

SEQ ID NO: 41 - protein, 393 aa, Balaenoptera acutorostrata scammoni
MTTYSNKGQKPERGQFLHFHSVTFWVGNAKQAASYYCSKMGFEPLAYKGLETGSREMVSHVIKQGKIVFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPAFVDPLLSKLPNCSLKIIDHIVGNQPDQEMVSASEWYLKNLQFHRFWSVDDTQVHTEYSSLRSIVVANYEESIKMPINEPAPGRKKSQIQEYVDYNGGAGVQHIALKTEDIITAIHHLRERGMEFLAVPSTYYKQLREKLKTAKIRVKENIDVLEELKILVDYDEKGYLLQIFTKPMQDRPTLFLEVIQRYNHQGFGAGNFNSLFKAFEEEQDLRGNLTDMETNGLVPGM

SEQ ID NO: 42 - protein, 393 aa, Lipotes vexillifer
  misc_feature (348)..(349): Xaa can be any naturally occurring amino acid
MTTYSNKGEKPEKGRFLHFHSVTFWVGNAKQAASYYCSKMGFEPLAYKGLETGSREMVSHVIKQGKIAFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPGFVDPLLSKLPNCSLEIIDHIVGNQPDQEMLSASEWYLKNLQFHRFWSVDDTQVHTEYSSLRSIVVANYEESIKMPINEPAPGRKKSQIQEYVDYNGGAGVQHVALKTEDIITAIRHLRERGMEFLAVPSTYYKQLREKLKSAKIRVKENIDVLEELKILVDYDEKGYLLQIFTKPMQDRPTLFXXVIQRYNHQGFGAGNFNSLFKAFEEEQDLRGNLTDMETNGTTCGM

SEQ ID NO: 43 - protein, 420 aa, Carlito syrichta
MRPRLDQKLPGLGPCRPRLSSRPHEGHQTTYSNKGPKPERGRFLHFHSVTFWVGNAKQAASFYCNKMGFEPFAYRGLETGAREVVSHVIKQGKIVFVLSSALNPWNKEMGDHLVKHGDGVKDITFEVEDCDSIVQKARERGAKIVREPWVEQDKFGKVKFAVLQTYGDTTHTLVEKVNYTGRFLPGFEAPVMTDPLLSKLPNCHLEIIDHIVGNQPDQEMVSASEWYLKNLQFHRFWSVDDKQVHTEYSSLRSVVVANYEESIKMPINEPAPGKKKSQIQEFVEYNGGAGVQHIALKTQDIITSIRHLRERGTEFLAVPSTYYKQIREKLKTAKIKVKENIDILEELRILVDYDEKGYLLQIFTKPMQDRPTLFLEIIQRHNHQGFGAGNFNALFKAFEEEQDLRGNLIDVNTNGVVPGM

SEQ ID NO: 44 - protein, 393 aa, Oryctolagus cuniculus
MTTYSDKGAKPERGRFLHFHSVTFWVGNAKQAASFYCTKMGFEPLAYRGLETGSRQVVSHVIKQGQIVFVLSSALNPGNKEMGDHLVKHGDGVKDIAFEVEDCDYIVQKARERGAKILREPWVEQDKFGKVKFAVLQTYGDTTHTLVEKMNYTGRFLPGFEAPMSKDPLLSKLPSCSLEIIDHIVGNQPEQEMVSASEWYLRNLQFHRFWSVDDTQVHTEYSSLRSIVVANYEESIKMPINEPAPGRKKSQIQEYVDYNGGAGVQHIALKTHDIISAIRHLRERGMEFLAVPATYYKQLREKLRSAKIRVTESIDVLEELKILVDYDEKGYLLQIFTKPMQDRPTLFLEVIQRHNHQGFGAGNFNSLFKAFEEEQNLRGNLTDMETNGVVPGM

SEQ ID NO: 45 - protein, 393 aa, Galeopterus variegatus
MTTYSNKGEKPERGRFLHFHSVTFWVGNAKQAASFYCSKMGFKPLAYKGLETGSREVVSHVIQQGKIVFVLSSALNPWNTEMGDHLVKHGDGVKDIAFEVEDCDYIVQKAQERGAKIMREPWVEQDKFGKVKFAVLQTYGDTTHTLVEKMNYSGRFLPGFEAPAFTDPLLSKLPDCCLEIIDHVVGNQPDQEMVSASEWYVKNLQFHRFWSVDDTQVHTEYSSLRSIVVANYEETIKMPINEPAQGKKKSQIQEYVDYNGGPGVQHIALKTQDIITAIRHLRERGLEFLGVPSTYYKQLREKLKSAKIRVKESIDVLEELKILVDYDEKGYLLQIFTKPMQDRPTLFLEVIQRHNHQGFGAGNFNSLFKAFEEEQDLRGNLTDLETNGVGPGI

SEQ ID NO: 46 - protein, 393 aa, Nannospalax galili
MTTYSNKGPKPERGRFLHFHSVTFWVGNAKQAASFYCNKMGFEPLAYKGLETGSREVVSHVIKQGKIVFVLCSALNPWNKEMGNHLVKHGDGVKDIAFEVEDCDHIVQKARERGAKIVREPWVEQDKFGKVKFAVLQTYGDTTHTLVEKMNYTGCFLPGFEAPTYKDPLLSKLPNCNLEIIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGMEFLAVPSSYYKLLRENLKTARIQVKESIDVLEELKILVDYDDKGYLLQIFTKPMQDRPTLFLEVIQRHNHQGFGAGNFNSLFKAFEEEQALRGNLTDTGTNRVMSGM

SEQ ID NO: 47 - protein, 393 aa, Mesitornis unicolor
QTTYTDKGEKPLRGRFIHFHSITFWVGNAKQAASYYCNKLGFEELAYRGLETGSREVVSHVIKQDKIVFVLSSALNPGNEEMGEHLVKHGDGVKDIAFEVEDCDFIVQKARERGAVVVKEPWVEEDKFGKVKFAVIQTYGDTTHTLVEKLNYKGLFLPGYHQPLFKDPLLPKLPSAKLSFVDHVVGNQPDLQMVPVADWYQKNLLFHRFWSVDDKQLHTEFSALRSIVVTNYEETIKMPINEPAFGKKKSQIQEYIDYYGGAGVQHIALNTSDIISAITNLKQRGMQFMDVPSSYYQVLRERLKTAKIKVKENIDKLAELKILVDFDEKGYLLQIFTKPVQDRPTVFLEVIQRHNHQGFGAGNFKSLFEAIEMDQDARGNLTILEPNGETKRI

SEQ ID NO: 48 - protein, 425 aa, Rhinopithecus roxellana
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDITFEVEDCDYIVQKARERGAKIVREPWVEQDKFGKVKFAVLQTYGDTTHTLVEKMNYTGQFLPGYEAPAFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITAIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLTDLETNGVVPGISASWQPREGQGGRQRSGTEEPRVPALCQEGSH

SEQ ID NO: 49 - protein, 393 aa, Fukomys damarensis
MTTYSDKGAKPERGRFLHFHSVTFWVGNAKQAAAFYCSKMGFEPLAYRGLETGSREVASHVIKQGQIVFVLSSPLNPWNREMGEHLAKHGDSVKDIGFEVEDCDYIVQKARERGAKVVREPWVEQDKFGKVKFAVLQTYGDTTHTLVEKVNYSGSFLPGFEAPRAKDPLLAKLPSCSLEMIDHIVGNQPDQEMVSASEWYLRSLQFHRFWSVDDTQVHTEYSSLRSIVVTNYEESIKMPINEPAPGKKKSQIQEYVDYNGGAGVQHIALGTQDIITSIRHLRERGVEFLAVPSTYYKQLRENLKSAKVQVKESIDMLEELKILVDYDEKGYLLQIFTKPVQDRPTLFLEVIQRHNHQGFGAGNFNALFKAFEAEQDLRGNLTDVETNGVESGL

SEQ ID NO: 50 - protein, 407 aa, Colobus angolensis palliatus
MPFEGQLHLIDSLTKTTYSDKGAKPERGRFLHFHSVTFWVGNAKQAASFYCSKMGFEPLAYRGLETGSREVVSHVIKQGKIVFVLSSALNPWNKEMGDHLVKHGDGVKDITFEVEDCDYIVQKARERGAKIVREPWVEQDKFGKVKFAVLQTYGDTTHTLVEKMNYTGQFLPGYEAPVFMDPLLPKLPKCSLEIIDHIVGNQPDQEMVSASEWYLKNLQFHRFWSVDDTQVHTEYSSLRSVVVANYEESIKMPINEPAPGKKKSQIQEYVDYNGGAGVQHIALNTQDIITAIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLTDLETNGVVPGM

SEQ ID NO: 51 - protein, 393 aa, Colobus angolensis palliatus
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDITFEVEDCDYIVQKARERGAKIVREPWVEQDKFGKVKFAVLQTYGDTTHTLVEKMNYTGQFLPGYEAPVFMDPLLPKLPKCSLEIIDHIVGNQPDQEMVSASEWYLKNLQFHRFWSVDDTQVHTEYSSLRSVVVANYEESIKMPINEPAPGKKKSQIQEYVDYNGGAGVQHIALNTQDIITAIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLTDLETNGVVPGM

SEQ ID NO: 52 - protein, 393 aa, Mandrillus leucophaeus
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIVREPWVEQDKFGKVKFAVLQTYGDTTHTLVEKMNYTGQFLPGYEAPVFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITAIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLTDLETNGVVPGM

SEQ ID NO: 53 - protein, 393 aa, Macaca nemestrina
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKAREQGAKIVREPWVEQDKFGKVKFAVLQTYGDTTHTLVEKMNYTGQFLPGYEAPVFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITAIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLTDLETNGVVPGM

SEQ ID NO: 54 - protein, 393 aa, Aotus nancymaae
MTTYSDKGAKPERGRFLHFHSVTFWVGNAKQAASFYCTKMGFEPLAYRGLETGSREVVSHVIKQGKIVFVLSSALNPWDKEMGDHLVKHGDGVKDIAFEVEDCDYIVQKARERGAKIVREPWVEEDKFGKVKFAVLQTYGDTTHTLVEKMNYAGRFLPGYEAPVFMDPLLPQLPKCSLEVIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLRERGMEFLSVPSTYYKQLREKLKVAKIKVKESIDVLEELKILVDYDEKGYLLQIFTKPVQDRPTLFLEVIQRHNHQGFGAGNFNSLFKAFEEEQNLRGNLTNMETDGVVPGM

SEQ ID NO: 55 - protein, 393 aa, Propithecus coquereli
MTTYSNKGAKPERGRFLHFHSVTFWVGNAKQAAAFYCSKMGFEPLAYRGLETGSREVVSHAIKQGQIVFVLSSALNPWNKEMGDHLVKHGDGVKDIAFEVEDCDYIVQKAWERGAKIVREPWVEQDKFGKVKFAVLQTYGDTTHTLVEKMNYTGRFLPGFEAPMFKDLLLSRLPSCSLEIIDHIVGNQPDQEMVPASEWYLKNLQFHRFWSVDDTQVHTEYSSLRSIVVANYEESIKMPINEPAPGRKKSQIQEYVDYNGGAGVQHIALKTQDIITAIRHLRERGMEFLAVPSTYYKQLREKLKTAKIRVKESIDVLEELKILVDYDEKGYLLQIFTKPVQDRPTLFLEIIQRHNHQGFGAGNFNSLFKAFEEEQDLRGNLTDLETNGAAPGT

SEQ ID NO: 56 - protein, 391 aa, Otolemur garnettii
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKAREQGAKIVREPWVEQDKFGKVKFAVLQTYGDTTHTLVEKMNYTGRFLPGFEAPTFKDPLLSKLPKCSLEIIDHIVGNQPDQEMVPASEWYLKNLQFHRFWSVDDTQVHTEYSSLRSIVVANYEESIKMPINEPAPGRKKSQIQEYVDYNGGAGVQHIALKTEDIIMAIRHLRERGMEFLAVPSTYYRQLRENLKTAKIQVKESIDVLEELKILVDYDEKGYLLQIFTKPMQDRPTLFLEVIQRRNHQGFGAGNFNSLFKAFEEEQDLRGNLTDLEPNGVVS

SEQ ID NO: 57 - protein, 410 aa, Cavia porcellus
MPWPPGTVSWEARPRPAMTTYSDKGEKPERGRFLHFHSVTFWVGNAKQAAAFYCSKMGFEPLAYRGLETGSREVASHVIKQGQIVFVFSSPLNPGNKELGDHLVKHGDGVKDIAFEVEDCDYIVQKARERGAKVVREPWVEQDRFGKVKFAVLQTYGDTTHTLVEKTGYTGSFLPGFEAPRVKDSLLSKLPNCGLEIIDHVVGNQPDQEMLSASEWYLKNLQFHRFWSVDDTQVHTEYSSLRSIVVTNYEESIKMPINEPAPGRKKSQIQEYVDYNGGAGVQHIALKTQDIITAIRHLRERGAEFLAVPSTYYKQLRENLKSAKVQVKENIDMLEELRILVDYDEKGYLLQIFTKPMQDRPTLFLEVIQRHNHQGFGAGNFNALFKAFEAEQDLRGNLTDLEPNGVASGM

SEQ ID NO: 58 - protein, 393 aa, Myotis brandtii
MTSYSNKGEKPERGRFLHFHSVTFWVGNAKQAASFYCSKMGFKPIAYKGLETGSREVVSHVVKQGQIVFVFSSALNPWNKEMGDHLVKHGDGVKDIAFEVEDCDYIVQKARQRGAKIIREPWVEQDKFGKVKFAVLQTYGDTTHTLVEKMNYTGFFLPGFEPTTNRDPVLSKLPQSNLEVIDHIVGNQPDQEMLSASARYLNNLQFHRFWSVDDTQVHTEYSSLRSIVVANYEESIKMPINEPAPGRKKSQIQEYVDYNGGAGVQHIALKTQDIITAIRHLRERGMEFLDVPSTYYKQLREKLKSAKIRVKESLDALEELKILVDYDENGYLLQIFTKPMQDRPTLFLEVIQRHNHQGFGAGNFNALFKAFEEEQNLRGNLTDLEPNGVIRGM

SEQ ID NO: 59 - protein, 393 aa, Equus asinus
MTTYSNKGEKPEKGRFLHFHSVTFWVGNAKQAASFYCNKLGFEPLAYKGLETGSREVVSYVIKQGKIIFVFSSALNPWNKEMGDHLVKHGDGVKDIAFEVEDCDYIVQKARERGAKIVREPWVEQDKFGKVKFAVLQTYGDTTHTLVEKMSYAGRFLPGFEAPAFRDPLLSKLPNCSLEIIDHVVGNQPDHEMESASEWYLKNLQFHRFWSVDDTQVHTEYSSLRSIVVANYEESIKMPINEPAPGRKKSQIQEYVDYNGGAGVQHIALKTHDIITAIRHLRERGMEFLAVPSSYYRQLQEKLKSAKIRVKESIDVLEELKILVDYDEKGYLLQIFTKPMQDRPTLFLEVIQRHNHQGFGAGNFNALFKAFEEEQDLRGNLTDMQTNILAPGK

SEQ ID NO: 60 - protein, 384 aa, Marmota marmota marmota
MTTYSDKGAKPERGRFLHFHSVTFWVGNAKQAASFYCSKMGFEPLAYRGLETGSREVVSHVVKQGKIVFVFSSALNPWNKEMGDHLVKHGDGVKDVAFEVEDCDYVVQKARERGAKIVREPWVEEDKFGKVKFAVLQTFGDTTHTLVEKTNYSGQFLPGFKAPLLKDSLLPKLPRCGLEIIDHVVGNLPDQEMLSASEWYLRNLQFHRFWSVDDTQVHTEYSSLRSIVVTNYEETIKMPINEPAMGMKKSSIQEYVDYNGGAGVQHVGLKTQDIITTIRNLQERGMEFLTVPSTYYKQLRENLKTAKIRVKESIDVLEELQILMDYDEKGYILQIFTKPMQDRPTLFLEVIQRHNHQGFGAGNFNSLFKALEDAQELRGNLTNL

SEQ ID NO: 61 - protein, 393 aa, Marmota marmota marmota
MTTYSDKGAKPERGRFLHFHSVTFWVGNAKQAASFYCSKMGFEPLAYRGLETGSREVVSHVVKQGKIVFVFSSALNPWNKEMGDHLVKHGDGVKDVAFEVEDCDYIVQKARERGAKIVQEPWVEEDKFGKVKFAVLQTYGDTTHTLVEKTNYTGRFLPGFEAPLLKDSLLPKLPKCGLEIIDHVVGNQPDQEMLSASEWYLRNLQFHRFWSVDDTQVHTEYSSLRSIVVTNYEETIKMPINEPAMGRKKSQIQEYVDYNGGAGVQHIALKTQDIITAIRSLRDRGLEFLSVPSTYYKQLRENLKTAKIRVKESIDVLEELKILVDYDEKGYLLQIFTKPMQDRPTLFLEVIQRHNHQGFGAGNFNSLFKAFEEEQAIRGNLTDLEIKGEVSGM

SEQ ID NO: 62 - protein, 393 aa, Cebus imitator
MTTYSDKGAKPERGRFLHFHSVTFWVGNAKQAASFYCNKMGFEPLAYRGLETGSREVVSHVIKQGKIVFVLSSALNPWNKEMGDHLVKHGDGVKDIAFEVEDCDYIVQKARERGAKIVREPWVEEDNFGKVKFAVLQTYGDTTHTLVEKMNYAGRFLPGYKAPAFMDPLLPQLPKCSLEVIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLRGRGMEFLSVPSMYYKQLREKLKVAKIKVKESIDVLEELKILVDYDEKGYLLQIFTKPVQDRPTLFLEVIQRHNHQGFGAGNFNSLFKAFEEEQDLRGNLTNMETDGVVPGM

SEQ ID NO: 63 - protein, 393 aa, Capra hircus
MTTYSDKGEKPERGRFLHFHSVTFWVGNAKQAASYYCSKLGFEPLAYKGLETGSREVVSHVVKQGQIVFIFSSALNPWNKEMGDHLVKHGDGVKDIAFEVEDCDYIVQKARERGAKIVREPWVEQDKLGKVKFAVLQTYGDTTHTLVEKMNYTGRFLPGFEAPAFMDPQLSKLPNCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTKDIITAIRHLRERGVEFLAVPSTYYKQLREKLESAKIRVKENIDILEELKILVDYDEKGYLLQIFTKPMQDRPTLFLEVIQRHNHQGFGAGNFNSLFKAFEEEQDLRGNLTDMEPNGVVSSM

SEQ ID NO: 64 - protein, 393 aa, Panthera pardus
MTTYSNKGEKPARGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKARERGAKIVREPWIEQDKFGKVKLAVLQTYGDTTHTLVEKMNYTGRFLPGFEAPAFVDPLLSKLPSCSLEIIDHIVGNQPDQEMESASDWYLKNLQFHRFWSVDDTQVHTEYSSLRSIVVANYEESIKMPINEPAPGKKKSQIQEYVDYNGGPGVQHIALKTQDIITAIRHLRERGMEFLGVPSTYYKQLREKLKSAKIRVKENIDVLEELKILVDYDEKGYLLQIFTKPVQDRPTLFLEVIQRHNHQGFGAGNFNSLFKAFEEEQNLRGNLTDLENNGIVPGM

SEQ ID NO: 65 - protein, 393 aa, Hipposideros armiger
MTSYSNKGEKPVRGRFLHFHSVTFWVGNAKQAASFYCNKMGFEPLAYKGLETGSREVVSHVIKQGEIVFVFSSALNPWHKEMGDHLVKHGDGVKDIAFEVEDCDYIVQKARERGAKIIREPWVEQDKFGKVKFAVLQTYGDTTHTLVEKMNYTGRFLPGFEAPVFKDPQLSKLPHCKLEVIDHIVGNQPDQEMVSASDWYLNNLQFHRFWSVDDTQVHTEYSSLRSIVVANYEESIKMPINEPAPGRKKSQIQEYVDYNGGAGVQHIALKTHDIITAIRHLRERGIEFLAVPSTYYKQLREKLKSAKIRVKENIDILEELKILVDYDEKGYLLQIFTKPMQDRPTLFLEVIQRHNHQGFGAGNFNSLFKAFEEEQNLRGNLTDMDTNGVIHGM

SEQ ID NO: 66 - protein, 393 aa, Crocodylus porosus
MTTYTDKGQKPERGRFLHFHSITFWVGNAKQAASYYCNKMGFEEMAYRGLETGSREVVSHVIRQDKIVFVLSSALNPGNEEMGAHLVKHGDGVKDVAFEVEDCDFIVQEARERGAAIVKEPWVEEDKHGRVKFAVIQTYGDTTHTLVEKLNYGGLFLPGFEAPLFKDQLLPKLPSTKLRFIDHVVGNQPDLEMVPVAEWYQRNLLFHRFWSVDDKQLHTEFSALRSIVVANYEETIKMPINEPAVGKKKSQIQEYIDYYGGPGVQHIALNTSDIISAITNLKQRGMEFMSVPATYYQQLRQRLKTAKIEVKESIDKLEELKILVDFDEKGYLLQIFTKPVQDRPTLFLEVIQRYNHQGFGAGNFKSLFEAIEADQDARGNLTLLTSNVENNFI

SEQ ID NO: 67 - protein, 393 aa, Ailuropoda melanoleuca
MTTYSDKGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGARIVREPWTEEDKFGKVKLAVLQTYGDTTHTLVEKMNYTGRFLPGFEAPASVDPLLSKLPSCSLEIIDHIVGNQPDQEMVSASEWYLKNLQFHRFWSVDDTQVHTEYSSLRSIVVANYEESIKMPINEPALGKKKSQIQEYVDYNGGAGVQHIALKTQDIITAIRHLRERGLEFLAVPSTYYKQLREKLKSAKIRVKESIDVLEELKILVDYDEKGYLLQIFTKPMQDRPTLFLEVIQRHNHQGFGAGNFNSLFKAFEEEQDLRGNLTDLETNGILRGM

SEQ ID NO: 68 - protein, 393 aa, Bos indicus
  misc_feature (155)..(155): Xaa can be any naturally occurring amino acid
  misc_feature (389)..(389): Xaa can be any naturally occurring amino acid
MTTYSDKGEKPERGRFLHFHSVTFWVGNAKQAASYYCSKLGFEPLAYKGLETGSREVVSHVVKQGQIVFVFSSALNPWNKEMGDHLVKHGDGVKDIAFEVEDCDYIVQKARERGAKIVREPWVEQDKLGKVKFAVLQTYGDTTHTLVEKMNYTGXFLPGFEAPPFMDPQLSKLPSCSLEIIDHIVGNQPDQEMVSASEWYLKNLQFHRFWSVDDTQVHTEYSSLRSVVVANYEESIKMPINEPAPGKKKSQIQEYVDYNGGAGVQHIALKTKDIITAIRHLRERGVEFLAVPSTYYKQLREKLKMAKIRVKENIDILEELKILVDYDEKGYLLQIFTKPMQDRPTLFLEVIQRHNHQGFGAGNFNSLFKAFEEEQDLRGNLTDMEPNGXVSGM

SEQ ID NO: 69 - protein, 393 aa, Castor canadensis
MTTYSDKGQKPEKGRFLHFHSVTFWVGNAKQAASFYCSKMGFEPLAYKGLETGSREVVSHVIKQGKIVFVLSSALNPWNKEMGDHLVKHGDGVKDIAFEVEDCDYIVQKARERGAKIVQEPWVEQDKFGKVKFAVLQTYGDTTHTLVEKMNYTGRFLPGFEAPTFKDPLLSKLPNCNLEIIDHIVGNQPDQEMVSASEWYLKNLQFHRFWSVDDTQVHTEYSSLRSIVVANYEESIKMPINEPAPGKKKSQIQEYVDYNGGAGVQHIALKTQDIIAAIRHLRERGMEFLAVPPTYYKQLRENLKLAKIQVKENIDVLEELKILVDYDEKGYLLQIFTKPMQDRPTLFLEVIQRHNHQGFGAGNFNSLFKAFEEEQALRGNLTDLEANGMVSGM

SEQ ID NO: 70 - protein, 393 aa, Sus scrofa
MTSYSDKGEKPERGRFLHFHSVTFWVGNAKQAASYYCSKIGFEPLAYKGLETGSREVVSHVVKQDKIVFVFSSALNPWNKEMGDHLVKHGDGVKDIAFEVEDCDYIVQKARERGAIIVREPWIEQDKFGKVKFAVLQTFGDTTHTLVEKMNYTGCFLPGFEAPTFTDPLLSKLPKCGLEIIDHIVGNQPDQEMESASQWYMRNLQFHRFWSVDDTQIHTEYSALRSVVMANYEESIKMPINEPAPGKKKSQIQEYVDYNGGAGVQHIALKTEDIITAIRSLRERGVEFLAVPFTYYKQLQEKLKSAKIRVKESIDVLEELKILVDYDEKGYLLQIFTKPMQDRPTVFLEVIQRNNHQGFGAGNFNSLFKAFEEEQELRGNLTDTDPNGVAFRL

SEQ ID NO: 71 - protein, 393 aa, Microcebus murinus
MTTYSNKGAKPERGRFLHFHSVTFWVGNAKQAAAFYCSKMGFEPLAYRGLETGSREVVSHVIKQGQIVFVLSSALNPWNKEMGDHLVKHGDGVKDIAFEVEDCDYIVQKARERGAKIVREPWVEQDKFGKVKFAVLQTYGDTTHTLVEKMGYTGRFLPGFEAPAFRDPLLPKLPNCTLEIIDHIVGNQPDQEMVPASEWYLKNLQFHRFWSVDDTQVHTEYSSLRSIVVANYEESIKMPINEPAPGKKKSQIQEYVDYNGGAGVQHIALKTQDIITAIRHLRERGTEFLAVPSTYYKQLREKLKTAKIRVKENIDVLEELKILVDYDEKGYLLQIFTKPVQDRPTLFLEVIQRHNHQGFGAGNFNSLFKAFEEEQALRGNLTDLETNGVVPGM

SEQ ID NO: 72 - protein, 393 aa, Odocoileus virginianus texanus
MTTYSDKGEKPERGRFLHFHSVTFWVGNAKQAASYYCSKLGFEPLAYKGLETGSREVVSHVVKQGQIVFVFSSALNPWNKEMGDHLVKHGDGVKDVAFEVEDCDYIVQKARERGAKIVREPWLEQDKLGKVKFAVLQTYGDTTHTLVEKMNYTGRFLPGFEAPAFMDPQLSKLPNCSLEIIDHIVGNQPDQEMVSASEWYLKNLQFHRFWSVDDTQVHTEYSSLRSIVVANYEESIKMPINEPAPGKKKSQIQEYVDYNGGPGVQHIALKTKDIITAIRHLRERGVEFLAVPSTYYKQLREKLKSAKIRVKENIDILEELKILVDYDEKGYLLQIFTKPMQDRPTLFLEVIQRHNHQGFGAGNFNSLFKAFEEEQDLRGNLTDTEPNGVVSSM

SEQ ID NO: 73 - protein, 393 aa, Phascolarctos cinereus
MTSYTDRGEKPPRGRFLHFHSITFWVGNAKQAASFYCHKMGFSPLAYRGLETGSREVASHVVKQGKIIFIFSSALNPGNKEMGDHLVKHGDGVKDISFEVEDCDYIVQKARERGAIIVKEPWIEQDKFGWVKFAVLQTYGDTTHTLVEKLNYTGPFLPGFEAPFFEDPLLPTLPDCKLAMIDHVVGNQPDQEMVPIADWYKKTLMFHRFWSVDDKQVHTEFSSLRSIVMANYEETIRMPINEPAMGRKKSQIQEYVDYYGGAGVQHIAMSTTDIISAITHLRARGMEFLNVPSTYYKQLRERLKSAKIQVKENMDILEKLKILVDYDEKGYLLQIFTKPVQDRPTVFLEVIQRHNHQGFGAGNFNSLFKAFEEEQNIRGNLTDLAPDGLGTVM

SEQ ID NO: 74 - protein, 393 aa, Mus pahari
MTSYTNKGPKPERGRFLHFHSVTFWVGNAKQAASFYCNKMGFEPLAYRGLETGSREVVSHVIKQGKIVFVLCSALNPWNKEMGDHLVKHGDGVKDIAFEVEDCDHIVQKARERGAKIVREPWVEQDKFGKVKFAVLQTYGDTTHTLVEKINYTGRFLPGFEAPTYKDTLLPKLPRCNLEIIDHIVGNQPDQEMQSASEWYLKNLQFHRFWSVDDTQVHTEYSSLRSIVVANYEESIKMPINEPAPGKKKSQIQEYVDYNGGAGVQHIALKTEDIITTIRHLRERGMEFLAVPSSYYKLLRENLKSAKIQVKESMDVLEELKILVDYDEKGYLLQIFTKPMQDRPTLFLEVIQRHNHQGFGAGNFNSLFKAFEEEQALRGNLTDMETNGVRSGM

SEQ ID NO: 75 - protein, 393 aa, Mus caroli
MTTYTNKGPKPERGRFLHFHSVTFWVGNAKQAASFYCNKMGFEPLAYRGLETGSREVVSHVIKQGKIVFVLCSALNPWNKEMGDHLVKHGDGVKDVAFEVEDCDHIVQKARERGAKIVREPWVEQDKFGKVKFAVLQTYGDTTHTLVEKINYTGRFLPGFEAPIYKDTLLPKLPRCNLEIIDHIVGNQPDQEMQSASEWYLKNLQFHRFWSVDDTQVHTEYSSLRSIVVTNYEESIKMPINEPAPGRKKSQIQEYVDYNGGAGVQHIALKTEDIITAIRHLRERGIEFLAVPSSYYKLLRENLKSAKIQVKENMDILEELQILVDYDEKGYLLQIFTKPMQDRPTLFLEVIQRHNHQGFGAGNFNSLFKAFEEEQALRGNLTDLEPNGVRSGM

SEQ ID NO: 76 - protein, 393 aa, Mesocricetus auratus
MTTYNNKGPKPERGRFLHFHSVTFWVGNAKQAASFYCNKMGFEPLAYKGLETGSREVVSHAIKQGKIVFVLCSALNPWNKEMGDHLVKHGDGVKDIAFEVEDCDHIVQKARERGAKIVREPWVEEDKFGKVKFAVLQTYGDTTHTLVEKINYTGRFLPGFEAPTYKDTLLPKLPRCNLEIIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITTIRHLRERGMEFLAVPSSYYKLLRENLKTAKIQVKESLDVLEELKILVDYDEKGYLLQIFTKPMQDRPTLFLEVIQRHNHQGFGAGNFNSLFKAFEEEQALRGNLTDMETNGVRSGM

SEQ ID NO: 77 - protein, 393 aa, Meriones unguiculatus
MTTYSNRGPKPERGQFLHFHSVTFWVGNAKQAASFYCNKMGFEPLAYRGLETGSREVVSHVIKQGKIVFVLSSALNPWNKEMGDHLVKHGDGVKDIAFEVEDCEHIVQKARERGAKIVREPWVEEDKFGKVKFAVLQTYGDTTHTLVEKINYTGRFLPGFEAPAYKDILLSKLPNCHLEIIDHIVGNQPDQEMESASEWYLKNLQFHRFWSVDDTQVHTEYSSLRSIVVANYEESIKMPINEPAPGRKKSQIQEYVDYNGGAGVQHIALKTEDIITTIRHLRERGMEFLAVPSSYYKLLRENLKTAKIQVKESMNVLEELKILVDYDEKGYLLQIFTKPMQDRPTLFLEVIQRHNHQGFGAGNFNALFKAFEQEQALRGNLTDLETNGVRSGM

SEQ ID NO: 78 - protein, 393 aa, Enhydra lutris kenyoni
MTTYSDRGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEQDKFGKVKLAVLQTYGDTTHTLVEKMNYTGRFLPGFEAPASVDPLLSKLPTCSLEIIDHIVGNQPDQEMVSASEWYLKNLQFHRFWSVDDTQVHTEYSSLRSIVVTNYEESIKMPINEPAPGRKKSQIQEYVDYNGGAGVQHIALKTQDIITAIRHLRARGMEFLGVPSSYYKQLREKLKSAKIQVKESIDVLEELKILVDYDEKGYLLQIFTKPMQDRPTLFLEVIQRHNHQGFGAGNFNSLFKAFEEEQDLRGNLTDLETNGTLRCM

SEQ ID NO: 79 - protein, 393 aa, Delphinapterus leucas
MTTYSNKGEKPERGRFLHFHSVTFWVGNAKQAASYYCSKMGFEPLAYKGLETGSREMVSHVIKQGKIVFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPAFVDPLLSKLPNCSLERIDHIVGNQPDQEMLSASEWYLKNLQFHRFWSVDDTQVHTEYSSLRSIVVANYEESIKMPINEPAPGRKKSQIQEYVDYNGGAGVQHIALKTEDIITAIRHLRERGMEFLAVPSTYYKQLREKLKSAKIRVKENIDVLEELKILVDYDEKGYLLQIFTKPMQDRPTLFLEVIHRYNHQGFGAGNFNSLFKAFEEEQDLRGNLTDMETNGTVAGM

SEQ ID NO: 80 - protein, 394 aa, Loxodonta africana
MTTYSDKGVKPERGRFLHFHSVTFWVGNAKQAASFYCSKMGFKPLAYRGLETGSREVVSHVIKHGKIVFVLSSALNPWNKEMGDHLVKHGDGVKDIAFEVEDCNYIVQKARERGAKIVREPWVEQDKCGRVKFAVLQTYGDTTHTLVEKINYTGCFLPGFEAPTFMDPLLSKLPSCNLEIIDHIVGNQPDQEMASASEWYLKNLQFHRFWSVDDTQVHTEYSSLRSIVVTNYEESIKMPINEPAPGKKKSQIQEYVDYNGGAGVQHIALRTQDIITAIRHLKERGMEFLAVPSTYYKQLREKLKSAKVQVKESIDVLEELKILVDYDEKGYLLQIFTKPVQDRPTLFLEVIQRNNHQGFGAGNFNSLFKAFEEEQNLRGNLTDLESNQPGRARH

SEQ ID NO: 81 - protein, 393 aa, Octodon degus
MTTYSDKGAKPERGRFLHFHSVTFWVGNAKQAAAYYCSKMGFELLAYRGLETGSREVASHVIKQGQIVFVFSSPLNPWNKEMGDHLVKHGDGVKDIAFEVQDCDYIVQKARERGAKVVREPWVEQDKFGKVKFAVLQTYGDTTHTLVEKMSYTGSFLPGFEAPRVKDALLFKLPSCGLEIIDHIVGNQPDQEMASASEWYLRNLQFHRFWSVDDTQVHTEYSSLRSIVVTNYEESIKMPINEPAPGRKKSQIQEYVDYNGGAGVQHIALKTQDIITAIRHLRERGAEFLAVPSSYYRQLRENLKSAKVRVKESIDVLEELKILVDYDEKGYLLQIFTKPMQDRPTLFLEVIQRHNHQGFGAGNFNALFKAFEAEQDLRGNLTDLETNGEVSGM

SEQ ID NO: 82 - protein, 393 aa, Chrysemys picta bellii
MTTYTDKGEKPEGGKFLHFHSLTFWVGNAKQAASFYCNKMGFEELAYKGLETGSREVVSHVIKQDKIIFVLSSALNPENKDMGEHLVKHGDGVKDIAFEVEDCDFIVQKAKERGAVIVKEPWVEEDKYGKVKFAVIQTYGDTTHTLIENLNYKGLFLPGFEPPLFKDPLLPKLPSGKLSFIDHVVGNQPDLQMVPVAEWYQKNLLFHRFWSVDDKQLHTQFSALRSIVVANYEETIKMPINEPAVGKKKSQIQEYVEYYGGAGVQHIALNTPDIITAVTNLKQRGIEFMTVPSTYYQQLREKLKSAKIKVKENIDKLEELKILVDFDEKGYLLQIFTKPVQDRPTVFLEVIQRHNHQGFGAGNFKSLFQAIEDDQDARGNLTILTANGETNFI

SEQ ID NO: 83 - protein, 393 aa, Pongo abelii
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIVREPWVEQDKFGKVKFAVLQTYGDTTHTLVEKMNYIGQFLPGYEAPAFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYKQLREKLKTAKIKVKENIDALEELKILVDYDEKGYLLQIFTKPVQDRPTLFLEVIQRHNHQGFGAGNFNSLFKAFEEEQNLRGNLTNMETNGVVPGM

SEQ ID NO: 84 - protein, 393 aa, Terrapene carolina triunguis
MTTYTDKGEKPEGGKFLHFHSLTFWVGNAKQAASFYCNKMGFEELAYKGLETGSREVVSHVIKQDKIIFVLSSALNPENKEMGEHLLKHGDGVKDIAFEVEDCDFIVQKAKERGAVIVKEPWVEEDKYGKVKFAVIQTYGDTTHTLIENLNYKGLFLPGFEPPLFKDPLLPKLPSGKLSFIDHVVGNQPDLQMVPVAEWYQKNLLFHRFWSVDDKQLHTQFSALRSIVVANYEETIKMPINEPAMGKKKSQIQEYVEYYGGAGVQHIALNTPDIITAVTNLKQRGMEFMTVPSTYYQQLREKLKSAKIKVKENIDKLEELKILVDFDEKGYLLQIFTKPVQDRPTVFLEVIQRHNHQGFGAGNFKSLFQAIEDDQDARGNLTILTANGETNFI

SEQ ID NO: 85 - protein, 393 aa, Neophocaena asiaeorientalis asiaeorientalis
MTTYSNKGEKPERGRFLHFHSVTFWVGNAKQAASYYCSKMGFESLAYKGLETGSREVVSHVIKQGKIVFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPAFVDPLLSKLPNCSLERIDHIVGNQPDQEMLSASEWYLKNLQFHRFWSVDDTQVHTEYSSLRSIVVANYEESIKMPINEPAPGRKKSQIQEYVDYNGGAGVQHIALKTEDITTAIRHLRERGMEFLAVPSTYYKQLREKLKSAKIRVKENIDVLEELKILVDYDEKGYLLQIFTKPMQDRPTLFLEVIQRYNHQGFGAGNFNSLFKAFEEEQDLRGNLTDMETNGTVAGM

SEQ ID NO: 86 - protein, 393 aa, Theropithecus gelada
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIVREPWVEQDKFGKVKFAVLQTYGDTTHTLVEKMNYTGQFLPGYEAPVFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITAIRHLRQRGMEFLSVPSTYYKQLREKLKTAKIKVKENIEVLEELKILVDYDEKGYLLQIFTKPVQDRPTLFLEVIQRHNHQGFGAGNFNSLFKAFEEEQNLRGNLTDLETNGVVPGM

SEQ ID NO: 87 - protein, 393 aa, Callorhinus ursinus
MTTYSDKGRKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEQDKFGKVKLAVLQTYGDTTHTLVEKMNYSGWFLPGFETPASVDPLLSKLPTCSLEIIDHIVGNQPDQEMVSASEWYLKNLQFHRFWSVDDTQVHTEYSSLRSIVVANFEESIKMPINEPAPGKKKSQIQEYVDYNGGAGVQHIALKTQDIITAIRHLRERGMEFLAVPPTYYKQLREKLKSAKIRVKESIDTLEELKILVDYDEKGYLLQIFTKPMQDRPTLFLEVIQRHNHQGFGAGNFNSLFKAFEEEQDLRGNLTDLKNTRTLPGT

SEQ ID NO: 88 - protein, 393 aa, Vulpes vulpes
MTTYSDKGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEEDKFGKVKLAVLQTYGDTTHTLVEKMNYTGRFLPGFEAPACVDPLLSKLPSCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLRDRGMEFLAVPSTYYKQLREKLKSAKIQVKESIDVLEELKILVDYDEKGYLLQIFTKPMQDRPTLFLEVIQRHNHQGFGAGNFNSLFKAFEEEQDLRGNLTDLETNGTMPGM

SEQ ID NO: 89 - protein, 384 aa, Urocitellus parryii
MTTYTDKGAKPERGRFLHFHSVTFWVGNAKQAASFYCSKMGFEPLAYRGLETGSREVVSHVVKQGKIVFVFSSALNPWNKEMGDHLVKHGDGVKDVAFEVEDCDYIVQKARERGAKVVREPWVEEDKFGKVKFAVLQTFGDTTHTLVEKTNYSGRFLPGFQAPLLKDSLLPKLPKCGLEIIDHVVGNLLDHEMLSASEWYLRNLQFHRFWSVDDTQVHTEYSSLRSIVVTNYEETIKMPINEPAMGMKKSSIQEYVDYNGGAGVQHVGLKTQDIITTIRNLQERGMEFLTVPSTYYKQLRENLKTAKIQVKESIDVLEELQILMDYDEKGYILQIFTRPMQDRPTLFLEVIQRHNHQGFGAGNFNSLFKALEDAQELRGNLTNL

SEQ ID NO: 90 - protein, 393 aa, Ursus arctos horribilis
MTTYSDKGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEQDKFGKVKLAMLQTYGDTTHTLVEKMNYTGRFLPGFEAPASVDPLLSKLPSCSLEIIDHIVGNQPDQEMVSASEWYLKNLQFHRFWSVDDTQVHTEYSSLRSIVVANYEESIKMPINEPALGKKKSQIQEYVDYNGGAGVQHIALKTQDIITAIRHLRERGLEFLAVPSTYYKQLREKLKSAKIRVKESIDVLEELKILVDYDEKGYLLQIFTKPMQDRPTLFLEVIQRHNHQGFGAGNFNSLFKAFEEEQDLRGNLTNLETNGILRGM

SEQ ID NO: 91 - protein, 393 aa, Acinonyx jubatus
MTTYSNKGEKPARGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKARERGAKIVREPWIEQDKFGKVKLAVLQTYGDTTHTLVEKMNYTGRFLPGFEAPAFVDPLLSKLPSCSLEIIDHIVGNQPDQEMESASDWYLKNLQFHRFWSVDDTQVHTEYSSLRSIVVANYEESIKMPINEPAPGKKKSQIQEYVDYNGGPGVQHIALKTQDIITAIRHLRERGMEFLAVPSTYYKQLREKLKSAKIRVKENIDVLEELKILVDYDEKGYLLQIFTKPVQDRPTLFLEVIQRHNHQGFGAGNFNSLFKAFEEEQNLRGNLTDFENNGIVPGM

SEQ ID NO: 92 - protein, 393 aa, Homo sapiens
MTTYSDKGAKPERGRFLHFHSVTFWVGNAKQATSFYCSKMGFEPLAYRGLETGSREVVSHVIKQGKIVFVLSSALNPWNKEMGDHLVKHGDGVKDIAFEVEDCDYIVQKARERGAKIMREPWVEQDKFGKVKFAVLQTYGDTTHTLVEKMNYIGQFLPGYEAPAFMDPLLPKLPKCSLEMIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYKQLREKLKTAKIKVKENIDALEELKILVDYDEKGYLLQIFTKPVQDRPTLFLEVIQRHNHQGFGAGNFNSLFKAFEEEQNLRGNLTNMETNGVVPGM

SEQ ID NO: 93 - protein, 461 aa, Gulo gulo
DDITLSTEAAARSEAPKPGSFQRWCRYHPSLGRPGSKGRDLFGVKYFCPALHWPLVPISEQEASPRSTMTTYSDKGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEQDKFGKVKLAVLQTYGDTTHTLVEKMNYTGRFLPGFEAPASVDPLLSKLPTCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLRARGMEFLCVPSTYYKQLREKLKSAKIQVKESIDVLEELKILVDYDEKGYLLQIFTKPMQDRPTLFLEVIQRHNHQGFGAGNFNSLFKAFEEEQDLRGNLTDLQTNGTLRGM

SEQ ID NO: 94 - protein, 393 aa, Bos indicus x Bos taurus
MTTYSDKGEKPERGRFLHFHSVTFWVGNAKQAASYYCSKLGFEPLAYKGLETGSREVVSHVVKQGQIVFVFSSALNPWNKEMGDHLVKHGDGVKDIAFEVEDCDYIVQKARERGAKIVREPWVEQDKLGKVKFAVLQTYGDTTHTLVEKMNYTGRFLPGFEAPPFMDPQLSKLPSCSLEIIDHIVGNQPDQEMVSASEWYLKNLQFHRFWSVDDTQVHTEYSSLRSVVVANYEESIKMPINEPAPGKKKSQIQEYVDYNGGAGVQHIALKTKDIITAIRHLRERGVEFLAVPSTYYKQLREKLKMAKIRVKENIDILEELKILVDYDEKGYLLQIFTKPMQDRPTLFLEVIQRHNHQGFGAGNFNSLFKAFEEEQDLRGNLTDMEPNGGVSGM

SEQ ID NO: 95 - protein, 393 aa, Tupaia chinensis
MTTYSDKGAKPQRGRFLHFHSVTFWVGNAKQAASFYCSKMGFEPLAYKGLETGSREVVSHVIRQGKIVFVLSSALNPWNKEMGDHLVKHGDGVKDIAFEVEDCDYIVQKARERGAKIVREPWVEKDKFGKVKFAVLQTYGDTTHTLVEKMNYTGRFLPGFEAPTYVDPHLAKLPDCNLEIIDHIVGNQPDQEMVSASEWYLRNLQFHRFWSVDDTQVHTEYSSLRSIVVANYEESIKMPINEPAPGKKKSQIQEYVDYNGGAGVQHIALKTHDIITAIRHLRERGMEFLAVPSTYYRQLREGLKSAKIQVKESIDALEELKILVDYDEKGYLLQIFTKPVQDRPTLFLEVIQRHNHQGFGAGNFNSLFKAFEEEQALRGNLTDLETNGVALGM

SEQ ID NO: 96 - protein, 393 aa, Vombatus ursinus
MTSYTDRGQKPPRGRFLHFHSITFWVGNAKQAASFYCHKMGFSPFAYRGLETGSRDVASHVVKQGKIIFIFSSALNPGNKEMGDHLVKHGDGVKDISFEVEDCDYIVQKARERGAIIVKEPWTEQDKFGWVKFAVLQTYGDTTHTLVEKLNYTGPFLPGFEAPLFEDPLLPTLPDCKLAMIDHVVGNQPDQEMVPAADWYKKNLMFHRFWSVDDKQVHTEFSSLRSIVMANYEETIKMPINEPAMGRKKSQIQEYVDYYGGAGVQHIAMSTPDIISAITYLRARGLEFLSVPSTYYKQLREGLKSAKIQVKESIDTLEELKILVDYDEKGYLLQIFTKPVQDRPTVFLEVIQRHNHQGFGAGNFNSLFKAFEEEQNIRGNLTDLAPNGLGIVM

SEQ ID NO: 97 - protein, 393 aa, Eptesicus fuscus
MTSYTNRGEKPERGRFLHFHSVTFWVGNAKQAASFYCSKMGFKPLAYKGLETGSREVVSHVVKQGQIVFVFSSALNPWNKEMGDHLVKHGDGVKDIAFEVEDCDYIVQKARQRGAKIIREPWVEQDKFGKVKFAVLQTYGDTTHTLVEKMNYTGFFLPGFEPTTNRDPALSKLPQSNLEVIDHIVGNQPDQEMLSASDWYLNNLQFHRFWSVDDTQVHTEYSSLRSIVVANYEESIKMPINEPAPGRKKSQIQEYVDYNGGAGVQHIALKTQDIITAIRHLRERGMEFLDVPSTYYKQLREKLKSAKIRVKESLDALEELRILVDYDENGYLLQIFTKPMQDRPTLFLEVIQRHNHQGFGAGNFNALFKAFEEEQNLRGNLTDMETNGVVRGM

SEQ ID NO: 98 - protein, 392 aa, Sousa chinensis
SLAPSLLLQPERGRFLHFHSVTFWVGNAKQAASYYCSKMGFEPLAYKGLETGSRETVSHVIKQGKIVFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPAFVDPLLSKLPNCSLERIDHIVGNQPDQEMLSASEWYLKNLQFHRFWSVDDTQVHTEYSSLRSIVVANYEESIKMPINEPAPGRKKSQIQEYVDYNGGAGVQHIALKTEDIITAIRHLRERGMEFLAVPSTYYKQLREKLKSAKIRVKENIDVLEELKILVDYDEKGYLLQIFTKPMQDRPTLFLEVIQRYNHQGFGAGNFNSLFKAFEEEQDLRGNLTDMETNGTVPGM

SEQ ID NO: 99 - protein, 393 aa, Platysternon megacephalum
MTTYTDKGEKPEGGKFLHFHSLTFWVGNAKQAASFYCNKMGFEELAYKGLETGSREVVSHVIKQDKIIFVLSSALNPENEEMGEHLVKHGDGVKDIAFEVEDCDFIVQKAKERGAVIVKEPWVEEDKYGKVKFAVIQTYGDTTHTLIENLNYKGLFLPGFEPPLFKDPLLPKLPSGKLSFIDHVVGNQLDLHMVPVAEWYQKNLLFHRFWSVDDKQLHTQFSSLRSIVVANYEETIKMPINEPAMGMKKSQIQEYVEYYGGAGVQHIALNTSDIITAVTNLKQRGMEFMVVPSTYYQQLREKLKSAKIKVKENIDKLEELKILVDFDGKGYLLQIFTKPVQDRPTVFLEVIQRHNHQGFGAGNFKSLFQAIEDDQDARGNLTILTANGETNSC

SEQ ID NO: 100 - protein, 393 aa, Grammomys surdaster
MTTYTNKGPKPERGRFLHFHSVTFWVGNAKQAASFYCNKMGFEPLAYRGLETGSREVVSHVIKQGKIVFVLCSALNPWNKEMGDHLAKHGDGVKDIAFEVEDCEYIVQKARERGAKIVREPWVEQDKFGKVKFAVLQTYGDTTHTLVEKVNYTGRFLPGFEAPTYKDNLLPKLPRCNLEIIDHIVGNQPDQEMESASEWYLKNLQFHRFWSVDDTQVHTEYSSLRSIVVANYEESIKMPINEPAPGKKKSQIQEYVDYNGGAGVQHIALKTEDIITTIRHLRERGMEFLAVPSSYYKMLRENLKRAKIQVKESLDVLEELKILVDYDEKGYLLQIFTKPMQDRPTLFLEVIQRHNHQGFGAGNFNALFKAFEEEQALRGNLTDLETNGVRSGM

SEQ ID NO: 101 - protein, 392 aa, Monodon monoceros
TTYSNKGEKPERGRFLHFHSVTFWVGNAKQAASYYCSKMGFEPLAYKGLETGSREMVSHVIKQGKIVFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPAFVDPLLSKLPNCSLERIDHIVGNQPDQEMLSASEWYLKNLQFHRFWSVDDTQVHTEYSSLRSIVVANYEESIKMPINEPAPGRKKSQIQEYVDYNGGAGVQHIALKTEDIITAIRHLRERGMEFLAVPSTYYKQLREKLKSAKIRVKENIDVLEELKILVDYDEKGYLLQIFTKPMQDRPTLFLEVIHRYNHQGFGAGNFNSLFKAFEEEQDLRGNLTDMETNGTVAGT

SEQ ID NO: 102 - protein, 393 aa, Monodon monoceros
MTTYSNKGEKPERGRFLHFHSVTFWVGNAKQAASYYCSKMGFEPLAYKGLETGSREMVSHVIKQGKIVFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPAFVDPLLSKLPNCSLERIDHIVGNQPDQEMLSASEWYLKNLQFHRFWSVDDTQVHTEYSSLRSIVVANYEESIKMPINEPAPGRKKSQIQEYVDYNGGAGVQHIALKTEDIITAIRHLRERGMEFLAVPSTYYKQLREKLKSAKIRVKENIDVLEELKILVDYDEKGYLLQIFTKPMQDRPTLFLEVIHRYNHQGFGAGNFNSLFKAFEEEQDLRGNLTDMETNGTAAGT

SEQ ID NO: 103 - protein, 393 aa, Suricata suricatta
MTTYSDKGEKPERGRFLHFHSVTFWVGNAKQAASFYCSKMGFEPLAYKGLETGSREVVSHAIKQGKIVFVFSSALNPWNKEIGDHLAKHGDGVKDIAFEVEDCDYIVQKAKERGAKVVREPWIEQDKFGKVKLAVLQTYGDTTHTLVEKMNYTGLFLPGFEAPVFLDPLLSKLPSCSLEIIDHIVGNQPDQEMVSAAEWYLKNLQFHRFWSVDDTQVHTEYSSLRSIVVANYEENIKMPINEPAPGKKKSQIQEYVDYNGGPGVQHIALKTQDIITAIRHLRERGMEFLGVPSTYYKQLRERLKSAKIRVKENIDVLEELKILVDYDEKGYLLQIFTKPMQDRPTLFLEVIQRHNHQGFGAGNFNSLFKAFEEEQNLRGNLTDLETNGVVPGM

SEQ ID NO: 104 - protein, 393 aa, Lynx canadensis
MTTYSNKGEKPARGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKARERGAKIVREPWIEQDKFGKVKLAVLQTYGDTTHTLVEKMNYTGRFLPGFEAPTFVDPLLSKLPSCSLEIIDHIVGNQPDQEMESASDWYLKNLQFHRFWSVDDTQVHTEYSSLRSIVVANYEESIKMPINEPALGKKKSQIQEYVDYNGGPGVQHIALKTQDIITAIRHLRERGMEFLGVPSTYYKQLREKLKSAKIRVKENIDVLEELKILVDYDEKGYLLQIFTKPVQDRPTLFLEVIQRHNHQGFGAGNFNSLFKAFEEEQNLRGNLTDLENNGIVPGM

SEQ ID NO: 105 - protein, 384 aa, Marmota monax
MTTYSDKGAKPERGRFLHFHSVTFWVGNAKQAASFYCSKMGFEPLAYRGLETGSREVVSHVVKQGKIVFVFSSALNPWNKEMGDHLVKHGDGVKDVAFEVEDCDYIVQKAREQGAKIVREPWVEEDKFGKVKFAVLQTFGDTTHTLVEKTNYSGRFLPGFKAPLLKDSLLPKLPRCGLEIIDHVVGNLLDHEMSSASEWYLRNLQFHRFWSVDDTQVHTEYSSLRSIVVTNYEETIKMPINEPAMGMKKSSIQEYVDYNGGAGVQHVGLKTQDIITTIRNLQERGMEFLTVPSTYYKQLRENLKTAKIRVKESIDVLEELQILMDYDEKGYILQIFTKPMQDRPTLFLEVIQRHNHQGFGAGNFNSLFKALEDAQELRGNLTNL

SEQ ID NO: 106 - protein, 393 aa, Nomascus leucogenys
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIVREPWIEQDKFGKVKFAVLQTYGDTTHTLVEKMNYIGQFLPGYEAPAFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYRQLREQLKTAKIKVKENIDVLEELKILVDYDEKGYLLQIFTKPVQDRPTLFLEVIQRHNHQGFGAGNFNSLFKAFEEEQNLRGNLTNMETSGVVPGM

SEQ ID NO: 107 - protein, 394 aa, Rhinopithecus roxellana
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDITFEVEDCDYIVQKARERGAKIVREPWVEQDKFGKVKFAVLQTYGDTTHTLVEKMNYTGQFLPGYEAPAFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITAIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLTDLETNGVVPGMQ

SEQ ID NO: 108 - protein, 393 aa, Muntiacus muntjak
MTTYSDKGEKPESGRFLHFHSVTFWVGNAKQAASYYCSKLGFEPLAYKGLETGSREVVSHVVKQGQIVFVFSSALNPWNKEMGDHLVKHGDGVKDIAFEVEDCDYIVQKARERGAKIVREPWVEQDKFGKVKFAVLQTYGDTTHTLVEKMNYTGRFLPGFEAPAFMDPQLSKLPNCSLEIIDHIVGNQPDQEMVSASEWYLKNLQFHRFWSVDDTQVHTEYSSLRSIVVANYEESIKMPINEPAPGKKKSQIQEYVDYNGGPGVQHIALKTKDIITAIRHLRERGVEFLAVPSTYYKQLREKLKSAKIRVKENIDILEELKILVDYDEKGYLLQIFTKPMQDRPTLFLEVIQRHNHQGFGAGNFNALFKAFEEEQDLRGNLTDMEPNGVVPGM

SEQ ID NO: 109 - protein, 393 aa, Mastomys coucha
MTTYTNKGPKPERGRFLHFHSVTFWVGNAKQAASFYCNKMGFEPLAYRGLETGSREVVSHVIKQGKIVFVLCSALNPWNKEMGDHLVKHGDGVKDIAFEVEDCEHIVQKARERGAKIVREPWVEQDKFGKVKFAVLQTYGDTTHTLVEKIDYTGRFLPGFEAPIYKDTLLPKLPRCNLEIIDHIVGNQPDQEMESASEWYLKNLQFHRFWSVDDTQVHTEYSSLRSIVVANYEESIKMPINEPAPGRKKSQIQEYVDYNGGAGVQHIALKTEDIITTIRHLRERGMEFLAVPSSYYKLLRENLKTAKIQVKESMDVLEELKILVDYDEKGYLLQIFTKPVQDRPTLFLEVIQRHNHQGFGAGNFNSLFKAFEEEQALRGNLTDLETNGVRSGM

SEQ ID NO: 110 - protein, 387 aa, Camelus dromedarius
MTTYSDKGEKPERGRFLHFHSVTFWVGNAKQAASYYCSKMGFEPLAYKGLETRSRDVVSHVIKQGKIVFVFSSALNPWNKEMGDHLVKHGDGVKDIAFEVEDCDYIVQKARERGAKIVREPWVEQDKFGKVKFAVLQTYGDTTHTLVEKMNYTGRFLPGFEAPASTDPLLSKLPNCCLEIIDHIVGNQPDQEMLSASEWYLKNLQFHRFWSVDDTQVHTEYSSLRSIVVANYEESIKMPINEPAPGRKKSQIQEYVDYNGGAGVQHIALNTQDIITAIRHLRERGMEFLAVPSTYYKQLREKLKSAKIRVKENIDVLEELKILVDYDEKGYLLQIFTKPMQDRPTLFLEVIQRHNHQGFGAGNFNSLFKAFEEEQDLRGNLTDMETS

SEQ ID NO: 111 - protein, 393 aa, Papio anubis
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIVREPWVEQDKFGKVKFAVLQTYGDTTHTLVEKMNYTGQFLPGYEAPVFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITAIRHLRQRGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLTDLETNGVVPGM

SEQ ID NO: 112 - protein, 393 aa, Sarcophilus harrisii
MTTYTDRGEKPPRGRFLHFHSITFWVGNAKQAASFYCNKMGFSPLAYRGLETGSREVASHVVKQGKIIFIFSSPLNPGNKEMGDHLVKHGDGVKDISFEVEDCDYIVQKARERGAVIVKEPWIEQDKFGRVKFAILQTYGDTTHTLVEKLNYTGPFLPGFETPRFLDPLLPKLPDCKLAMIDHVVGNQPDQEMVTAAEWYKKNLLFHRFWSVDDKQVHTEFSSLRSIVMANYEETIKMPINEPAMGRKKSQIQEYVDYYGGAGVQHIAMSTPDIISAITHLKARGMEFLSAPATYYKQLREGLKAAKMQVKENIDKLEELKILVDYDEKGYLLQIFTKPVQDRPTVFLEVIQRHNHQGFGAGNFNALFKAFEEEQSVRGNLTDLAPNGVGIAM

SEQ ID NO: 113 - protein, 393 aa, Crocuta crocuta
SSLSSSLLLQPERGRFLHFHSVTFWVGNAKQAASFYCNKMGFEPLAYKGLETGSREVVSHVIKQGKIVFVFSSALNPWDKEMGDHLVKHGDGVKDIAFEVEDCDYIVQKAKERGAKIVREPWIEQDKFGKVKLAVLQTYGDTTHTLVEKMNYTGRFLPGFEAPVFIDPILSKLPSCSLEIIDHIVGNQPDQEMVSASEWYLKNLQFHRFWSVDDTQVHTEYSSLRSIVVANYEESIKMPINEPALGKKKSQIQEYVDYNGGPGVQHIALKTQDIITAIRHLRERGMEFLGVPSTYYKQLREKLKSAKIRVKENIDVLEELKILVDYDEKGYLLQIFTKPMQDRPTLFLEVIQRHNHQGFGAGNFNSLFKAFEEEQNLRGNLTDLETNGTVRGM

SEQ ID NO: 114 - protein, 393 aa, Hylobates moloch
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIVREPWVEQDKFGKVKFAVLQTYGDTTHTLVEKMNYIGQFLPGYEAPAFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYRQLREQLKTAKIKVKENIDVLEELKILVDYDEKGYLLQIFTKPVQDRPTLFLEVIQRHNHQGFGAGNFNSLFKAFEEEQNLRGNLTNMETSGVVPGM

SEQ ID NO: 115 - protein, 393 aa, Sapajus apella
MTTYSDKGAKPERGRFLHFHSVTFWVGNAKQAASFYCNKMGFEPLAYRGLETGSREVVSHVIKQGKIVFVLSSALNPWNKEMGDHLVKHGDGVKDIAFEVEDCDYIVQKARERGAKIVREPWVEEDKFGKVKFAVLQTYGDTTHTLVEKMNYAGRFLPGYKAPAFMDPLLPQLPKCSLEVIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLRGRGMEFLSVPSTYYKQLREKLKVAKIKVKESIDVLEELKILVDYDEKGYLLQIFTKPVQDRPTLFLEVIQRHNHQGFGAGNFNSLFKAFEEEQDLRGNLTNMETDGVVPGM

SEQ ID NO: 116 - protein, 393 aa, Mustela erminea
MTTYSDKGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYLVQKAREQGAKIVREPWIEQDKFGKVKLAVLQTYGDTTHTLVEKMNYTGRFLPGFEAPVSVDPLLSKLPTCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLKARGMEFLGVPSSYYRQLREKLKTAKIQVKENIDVLEELKILVDYDEKGYLLQIFTKPMQDRPTLFLEVIQRHNHQGFGAGNFNALFKAFEEEQDLRGNLTNLETNSSLRGM

SEQ ID NO: 117 - protein, 387 aa, Camelus ferus
MTTYSDKGEKPERGRFLHFHSVTFWVGNAKQAASYYCSKMGFEPLAYKGLETRSRDVVSHVIKQGKIVFVFSSALNPWNKEMGDHLVKHGDGVKDIAFEVEDCDYIVQKARERGAKIVREPWVEQDKFGKVKFAVLHTYGDTTHTLVEKMNYTGRFLPGFEAPASTDPLLSKLPNCCLEIIDHIVGNQPDQEMLSASEWYLKNLQFHRFWSVDDTQVHTEYSSLRSIVVANYEESIKMPINEPAPGRKKSQIQEYVDYNGGAGVQHIALNTQDIITAIRHLRERGMEFLAVPSTYYKQLREKLKSAKIRVKENIDVLEELKILVDYDEKGYLLQIFTKPMQDRPTLFLEVIQRHNHQGFGAGNFNSLFKAFEEEQDLRGNLTDMETS

SEQ ID NO: 118 - protein, 393 aa, Phocoena sinus
MTTYSNKGEKPERGRFLHFHSVTFWVGNAKQAASYYCSKMGFESLAYKGLETGSREMVSHVIKQGKIVFIFSSALNPWNKEMGDHLVKHGDGVKDIAFEVEDCDYIAQKARERGAKIVREPWVEQDKFGKVKFAVLQTYGDTTHTLVEKMNYTGWFLPGFEVPAFVDPLLSKLPNCSLERIDHIVGNQPDQEMLSASEWYLKNLQFHRFWSVDDTQVHTEYSSLRSIVVANYEESIKMPINEPAPGRKKSQIQEYVDYNGGAGVQHIALKTEDIITAIRHLRERGMEFLAVPSTYYKQLREKLKSAKIRVKENIDVLEELKILVDYDEKGYLLQIFTKPMQDRPTLFLEVIQRYNHQGFGAGNFNSLFKAFEEEQDLRGNLTDMETNGTVAGM

SEQ ID NO: 119 - protein, 393 aa, Lontra canadensis
MTTYSDKGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEQDKFGKVKLAVLQTYGDTTHTLVEKMNYTGRFLPGFEAPASVDPLLSKLPTCSLEIIDHIVGNQPDQEMVSASEWYLKNLQFHRFWSVDDTQVHTEYSSLRSIVVANYEESIKMPINEPAPGRKKSQIQEYVDYNGGAGVQHIALKTQDIITAIRHLRARGMEFLCVPSSYYKQLREKLKSAKIQVKESIDVLEELKILVDYDEKGYLLQIFTKPMQDRPTLFLEVIQRHNHQGFGAGNFNSLFKAFEEEQDLRGNLTDLETNGTLRGM

SEQ ID NO: 120 - protein, 393 aa, Tyto alba
MTTYTDKGEKPLRGRFIHFHSITFWVGNAKQAASYYCNKMGFEELAYRGLETGSREVVSHVIKQDKIVFVLSSALNPGNEEMGEHLVKHGDGVKDIAFEVEDCDFIVQKAKERGAVVVKEPWVEEDKFGKVKFAVIQTYGDTTHTLIEKLNYKGLFLPGYHPPLFKDPLLPKLPSAKLNFVDHVVGNQPDLQMVPVADWYQKNLLFHRFWSVDDKQLHTEFSALRSIVVTNYEETIKMPINEPAFGKKKSQIQEYVDYYGGAGVQHIALNTSDIISAITNLKQRGMQFMDVPSSYYQMLRERLKTAKIKVKENIDKLAELKILVDFDEKGYLLQIFTKPVQDRPTVFLEVIQRHNHQGFGAGNFKSLFEAIEIDQDARGNLTILEPNGETKRI

SEQ ID NO: 121 - protein, 394 aa, Trachypithecus francoisi
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDLTFEVEDCDYIVQKARERGAKIVREPWVEQDKFGKVKFAVLQTYGDTTHTLVEKMNYTGQFLPGYEAPAFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITAIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLTDLETNGVVPGMQ

SEQ ID NO: 122 - protein, 392 aa, Mirounga leonina
TTYSDKGKKPQRGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEQDKFGKVKLAVLQTYGDTTHTLVEKMNYSGRFLPGFETPASVDPLLSKLPSCSLEMVDHIVGNQPDQEMVSASEWYLKNLQFHRFWSVDDTQVHTEYSSLRSIVVANFEESIKMPINEPAPGKKKSQIQEYVDYNGGAGVQHIALKTQDIITAIRHLRERGMEFLAVPPTYYKQLREKLKSAKIRVKESIDTLEELKILVDYDEKGYLLQIFTKPMQDRPTLFLEVIQRHNHQGFGAGNFNSLFKAFEEEQDLRGNLTDSENTRTLPGM

SEQ ID NO: 123 - protein, 393 aa, Arvicanthis niloticus
MTTYTNKGPKPERGRFLHFHSVTFWVGNAKQAASFYCNKMGFEPLAYRGLETGSREVVSHVIKQGKIVFVLCSALNPWNKEMGDHLVKHGDGVKDIAFEVEDCEHIVQKARERGAKIIREPWVEEDKFGKVKFAVLQTYGDTTHTLVEKINYTGRFLPGFEAPTYKDNLLPKLSRCKLEVIDHIVGNQPDQEMESASEWYLKNLQFHRFWSVDDTQVHTEYSSLRSIVVANYEESIKMPINEPAPGRKKSQIQEYVDYNGGAGVQHIALKTEDIITTIRHLRERGMEFLAVPSSYYKMLRENLKIAKIQVKESMDVLEELKILVDYDEKGYLLQIFTKPMQDRPTLFLEVIQRHNHQGFGAGNFNALFKAFEEEQALRGNLTDLETNGVRSGM

SEQ ID NO: 124 - protein, 393 aa, Trachemys scripta elegans
MTTYTDKGEKPEGGKFLHFHSLTFWVGNAKQAASFYCNKMGFEELAYKGLETGSREVVSHVIKQDKIIFVLSSALNPENKEMGEHLVKHGDGVKDIAFEVEDCDFIVQKAKERGAVIVKEPWVEEDKYGKVKFAVIQTYGDTTHTLIENLNYKGLFLPGFELPLFKDPLLPKLPSGKLSFIDHVVGNQPDLQMVPVAEWYQKNLLFHRFWSVDDKQLHTQFSALRSIVVANYEETIKMPINEPAVGKKKSQIQEYVEYYGGAGVQHIALNTPDIITAVTNLKQRGMEFMTVPSTYYQQLREKLKSAKIKVKENIDKLEELKILVDFDEKGYLLQIFTKPVQDRPTVFLEVIQRHNHQGFGAGNFKSLFQAIEDDQDARGNLTILTANGETNFI

SEQ ID NO: 125 - protein, 393 aa, Pan paniscus
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIVREPWVEQDKFGKVKFAVLQTYGDTTHTLVEKMNYIGQFLPGYEAPAFMDPLLPKLPKCRLEMIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYKQLREKLKTAKIKVKENIDALEELKILVDYDEKGYLLQIFTKPVQDRPTLFLEVIQRHNHQGFGAGNFNSLFKAFEEEQNLRGNLTNMETNGVVPGM

SEQ ID NO: 126 - protein, 393 aa, Callithrix jacchus
MTTYSDKGAKPERGRFLHFHSVTFWVGNAKQAASFYCTKMGFEPLAYRGLETGSREVVSHVIKQGKIVFVLSSALNPWNKEMGDHLVKHGDGVKDITFEVEDCDYIVQKARERGAKIVQEPWVEEDKFGKVKFAVLQTFGDITHTLVEKMSYAGRFLPGYEAPVFMDPLLPQLPKCSLKVIDHIVGNQPDQEMASASEWYLKNLQFHRFWSVDDTQVHTEYSSLRSIVVANYEESIKMPINEPAPGKKKSQIQEYVEYNGGAGVQHIALKTQDIITAIRHLRERGLEFLSVPSTYYKQLREKLKVAKIKVKESIDVLEELKILVDFDEKGYLLQIFTKPVQDRPTLFLEVIQRHNHQGFGAGNFNSLFKAIEEEQNLRGNLTNRETDGVVPGM

SEQ ID NO: 127 - protein, 393 aa, Canis lupus dingo
MTTYSDKGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEEDKFGKVKLAVLQTYGDTTHTLVEKINYTGRFLPGFEAPACVDPLLSKLPSCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLRDRGMEFLAVPSTYYKQLREKLKSAKIQVKESIDVLEELKILVDYDEKGYLLQIFTKPMQDRPTLFLEVIQRHNHQGFGAGNFNSLFKAFEEEQDLRGNLTDLETNGMMPGM

SEQ ID NO: 128 - protein, 430 aa, Rhinolophus ferrumequinum
MEFLGAAAELEMGSCPGALSTPASCPVFQAGSLTKINMTTYSDKGQKPERGRFLHFHSVTFWVGNAKQAASFYCSKMGFEPLAYKGLETGSREVVSHVVKQGEIVFVFCSALNPWNKEMGDHLVKHGDGVKDIAFEVEDCEYIVQKARERGAKIIREPWVEQDKFGKVKFAVLQTYGDTTHTLVEKMNYTGRFLPGFEAPTFTDPLLSKLPHCKLEIIDHIVGNQPDQEMTSASDWYLKNLQFHRFWSVDDTQVHTEYSSLRSIVVANYEESIKMPINEPAPGRKKSQIQEYVDYNGGAGVQHIALKTQDIITAIRRLRERGMEFLAVPSTYYKQLREKLKTAKIRVKENIDVLEELKILVDYDEKGYLLQIFTKPMQDRPTLFLEVIQRHNHQGFGAGNFNSLFKAFEEEQNLRGNLTDMETNGVITGM

SEQ ID NO: 129 - protein, 393 aa, Rhinolophus ferrumequinum
MTTYSDKGQKPERGRFLHFHSVTFWVGNAKQAASFYCSKMGFEPLAYKGLETGSREVVSHVVKQGEIVFVFCSALNPWNKEMGDHLVKHGDGVKDIAFEVEDCEYIVQKARERGAKIIREPWVEQDKFGKVKFAVLQTYGDTTHTLVEKMNYTGRFLPGFEAPAFTDPLLSKLPHCKLEIIDHIVGNQPDQEMTSASDWYLKNLQFHRFWSVDDTQVHTEYSSLRSIVVANYEESIKMPINEPAPGRKKSQIQEYVDYNGGAGVQHIALKTQDIITAIRRLRERGMEFLAVPSTYYKQLREKLKTAKIRVKENIDVLEELKILVDYDEKGYLLQIFTKPMQDRPTLFLEVIQRHNHQGFGAGNFNSLFKAFEEEQNLRGNLTDMETNGVITGM

SEQ ID NO: 130 - protein, 393 aa, Phyllostomus discolor
MTSYSDKGQKPERGRFLHFHSVTFWVGNAKQAASFYCSKVGFEPLAYKGLETGSREVVSHVVKQGQIVFVFSSALNPWNKEMGDHLVKHGDGVKDIAFEVEDCDYIVQKARERGAKIIREPWVEQDKFGKVKLAVLQTYGDTTHTLVEKMNYTGCFLPGFEAVDCKDPLLSKLPQCGLEVVDHIVGNQPDQEMQSASEWYLKNLQFHRFWSVDDTQVHTEYSSLRSIVVANYEESIKMPINEPAPGRKKSQIQEYVDYNGGAGVQHIALKTGDIISAIRHLRERGMEFLHVPSTYYKQLREKLKSAKIRVKENLDVLEELRILVDYDEKGYLLQIFTKPMQDRPTLFLEVIQRHNHQGFGAGNFNALFKAFEEEQALRGNLTDMEINGIARGM

SEQ ID NO: 131 - protein, 393 aa, Halichoerus grypus
MTTYSDKGKKPQRGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIVREPWIEQDKFGKVKLAVLQTYGDTTHTLVEKMNYSGRFLPGFETPASVDPLLSKLPSCSLEMIDHIVGNQPDQEMVSASEWYLKNLQFHRFWSVDDTQVHTEYSSLRSIVVANFEESIKMPINEPAPGKKKSQIQEYVDYNGGAGVQHIALKTQDIITAIRHLRERGMEFLAVPPTYYKQLREKLKSAKIRVKESIDTLEELKILVDYDEKGYLLQIFTKPMQDRPTLFLEVIQRHNHQGFGAGNFNSLFKAFEEEQDLRGNLTDLENTRTLPGM

SEQ ID NO: 132 - protein, 393 aa, Onychomys torridus
MTSYTNKGPKPERGRFLHFHSVTFWVGNAKQAASFYCNKMGFEPLAYKGLETGSREVVSHVIKQGKIVFVLCSALNPWNKEMGDHLVKHGDAVKDIAFEVEDCEHIVQKARERGAKIVREPWVEQDKFGKVKFAVLQTYGDTTHTLVEKINYTGRFLPGFEAPTHKDTLLSKLPSCNLEVIDHIVGNQPDQEMTSASEWYLKNLQFHRFWSVDDTQVHTEYSSLRSIVVANYEESIKMPINEPAPGKKKSQIQEYVDYNGGAGVQHIALKTEDIITTIRHLRERGMEFLAVPSSYYKLLRGNLKTAKIQVKESMDVLEELKILVDYDEKGYLLQIFTKPMQDRPTLFLEVIQRHNHQGFGAGNFNSLFKAFEEEQALRGNLTDLETNGVRSGM

SEQ ID NO: 133 - protein, 393 aa, Rousettus aegyptiacus
MTSYSDKGKKPERGRFLHFHSVTFWVGNAKQAASFYCSKMGFEPLAYRGLETGSREVASHVIKQGQIVFVFSSALNPWNKEMGDHLVRHGDGVKDVAFEVQDCDSIVQKAQERGAKIIREPWVEQDKFGKVKFAVLQTFGDTTHTLVEKMNYRGPFLPGFMARAPRDSLLSKLPQCNLEVIDHVVGNQPDQEMLSASEWYLNNLQFHRFWSVDDKELHTEYSSLRSIVVTNYEESIKIPINEPAPGRKKSQIQEYVDYYGGAGVQHIALKTQDIITTIRSLKERGMEFLNTPPTYYKQLREKLKSAKIRVQENMDTLEELKILVDYDENGYLLQIFSKPMQDRPTLFLEVIQRHNHQGFGAGNFNSLFKALEEEQNLRGNLTDLETNGVVPGM

SEQ ID NO: 134 - protein, 393 aa, Molossus molossus
MTSYSNKGEKPERGRFLHFHSVTFWVGNAKQAASFYCSKMGFKPLAYRGLETGSRDVVSHVVKQGQIVFVFSSALNPWNKDMGDHLVKHGDGVKDIAFEVEDCDYIVQKARERGAKIIREPWVEQDKFGKVKFAVLQTYGDTTHTLVEKMKYTGFFLPGFEPVAKMDPALSKLPQCNLEVIDHIVGNQPDQEMESASDWYLNNLQFHRFWSVDDTQVHTEYSSLRSIVVANYEESIKMPINEPAPGRKKSQIQEYVEYNGGAGVQHIALKTQDIITAIRHLRERGMEFLDVPSTYYKQLREKLKSAKIRVKENIEILEELRILVDYDEKGYLLQIFTKPMQDRPTLFLEVIQRHNHQGFGAGNFNALFKAFEEEQNLRGNLTDMEPNGVLRGM

SEQ ID NO: 135 - protein, 393 aa, Myotis myotis
MTSYSNKGEKPERGRFLHFHSVTFWVGNAKQAASFYCSKMGFKPIAYKGLETGSREVVSHVVKQGQIVFVFSSALNPWNKEMGDHLVKHGDGVKDIAFEVEDCDYIVQKARQRGAKIIREPWVEQDKFGKVKFAVLQTYGDTTHTLVEKMNYTGFFLPGFEPTTNRDPALSKLPQSNLEVIDHIVGNQPDQEMLSASDWYLNNLQFHRFWSVDDTQVHTEYSSLRSIVVANYEESIKMPINEPAPGRKKSQIQEYVDYNGGAGVQHIALKTQDIITAIRHLRERGMEFLDVPSTYYKQLREKLKSAKIRVKENLDALEELKILVDYDENGYLLQIFTKPMQDRPTLFLEVIQRHNHQGFGAGNFNALFKAFEEEQNMRGNLTDLEPNGVIRGM

SEQ ID NO: 136 - protein, 393 aa, Pipistrellus kuhlii
MTSYTNKGEKPERGRFLHFHSVTFWVGNAKQAASYYCSKMGFKPLAYRGLETGSREVVSHVVKQGQIVFIFSSALNPWNKEMGDHLVKHGDGVKDIAFEVEDCDYIVQKARQRGAKIIREPWVEQDKFGKVKFAVLQTYGDTTHTLVEKMDYTGLFLPGFNPTTHTDSVLSKLPQSNLEVIDHIVGNQPDQEMLSASDWYLNNLQFHRFWSVDDTQVHTEYSSLRSIVVANYEESIKMPINEPAPGRKKSQIQEYVDYNGGAGVQHIALKTQDIITAIRHLRERGMEFLDVPATYYRQLREKLKSAKIRVKESLDTLEELKILVDYDENGYLLQIFTKPMQDRPTLFLEVIQRHNHQGFGAGNFNALFKAFEEEQNLRGNLTDMETNGVVRGM

SEQ ID NO: 137 - protein, 393 aa, Balaenoptera musculus
MTTYSNKGQKPERGQFLHFHSVTFWVGNAKQAASYYCSKMGFEPLAYKGLETGSREMVSHVIKQGKIVFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPAFVDPLLSKLPNCSLKIIDHIVGNQPDQEMVSASEWYLKNLQFHRFWSVDDTQVHTEYSSLRSIVVANYEESIKMPINEPAPGRKKSQIQEYVDYNGGAGVQHIALKTEDIITAIHHLRERGMEFLAVPSTYYKQLREKLKTAKIRVKENIDVLEELKILVDYDEKGYLLQIFTKPMQDRPTLFLEVIQRYNHQGFGAGNFNSLFKAFEEEQDLRGNLTDMETNGLAPGM

SEQ ID NO: 138 - protein, 393 aa, Manis pentadactyla
MTTYSNQGEKPERGRFLHFHSVTFWVGNAKQAASFYCSKMGFEPLAYKGLETGSREVVSHVIKQGKIVFVFSSALNPWNREMGDHLVKHGDGVKDIAFEVEDCDYIVQKARERGAKIVQEPWVEQDKFGKVKFAVLQTYGDTTHTLVEKMNYSGCFLPGFEPLVFTDPLLSKLPKCYLEIIDHIVGNQPDQEMVSASEWYLKNLQFHRFWSVDDTQVHTEYSSLRSIVVANYEESIKMPINEPAPGRKKSQIQEYVDYNGGAGVQHIALKTQDIITAIRHLRERGLEFLAVPPTYYKQLREKLKSAKIRVKESIDTLEELKVLVDYDEKGYLLQIFTKPVQDRPTLFLEVIQRHNHQGFGAGNFNSLFKAFEEEQDLRGNLTDMEANGSMPGR

SEQ ID NO: 139 - protein, 393 aa, Manis javanica
MTTYSNQGEKPERGRFLHFHSVTFWVGNAKQAASFYCSKMGFEPLAYKGLETGSREVVSHVIKQGKIVFVFSSALNPWNREMGNHLVKHGDGVKDIAFEVEDCDYIVQKARERGAKIVQEPWVEQDKFGKVKFAVLQTYGDTTHTLVEKMNYSGCFLPGFEPLVLTDPLLSKLPKCYLEIIDHIVGNQPDQEMVSASEWYLKNLQFHRFWSVDDTQVHTEYSSLRSIVVANYEESIKMPINEPAPGRKKSQIQEYVDYNGGAGVQHIALKTQDIITAIRHLRERGLEFLAVPPTYYKQLRQKLKSAKIRVKESIDTLEELKVLVDYDEKGYLLQIFTKPVQDRPTLFLEVIQRHNHQGFGAGNFNSLFKAFEEEQDLRGNLTDMEANGSMPGK

SEQ ID NO: 140 - protein, 393 aa, Sturnira hondurensis
MTSYSNKGPKPERGRFVHFHSVTFWVGNAKQAASFYCTRMGFEPLAYRGLETGSREVVSHVVKQGQIVFVFSSALNPWNKEMGDHLVKHGDGVKDVAFEVEDCDYIVQKAQERGAKIIREPWVEQDKFGKVKFAVLQTYGDTTHTLVEKMSYTGCFLPGFKGLDSKDALLSKLPHCCLEVIDHIVGNQPDQEMQSASEWYLKNLQFHRFWSVDDTQVHTEYSSLRSIVVTNYEESIKMPINEPAPGKKKSQIQEYVDFNGGAGVQHIALKTQDIISAIRHLRERGMEFLHVPSTYYKQLREKLKSAKIRVKENMDVLEELNILVDYDDKGYLLQIFTKPMQDRPTLFLEIIQRHNHQGFGAGNFNALFEAIEEEQALRGNLTDLETNGVVQGK

SEQ ID NO: 141 - protein, 393 aa, Talpa occidentalis
MTTYSDKGAKPERGRFLHFHSVTFWVGNAKQAASFYCSKMGFEPLAYRGLETGSREVVSHVVKQGKIVFVLSSALNPWNKEMGDHLVKHGDGVKDIAFEVEDCDYIVQKARERGAKIVREPWVEEDKFGKVKFAVLQTYGDTTHTLVEKMNYTGRFLPGFEAPTFMDPLLSKLPSCTLEIIDHIVGNQPDQEMLSASDWYLKNLQFHRFWSVDDTQVHTEYSSLRSIVVANYEESIKMPINEPAPGKKKSQIQEYVDYNGGAGVQHIALKTQDIIKAIRHLRERGMEFLAVPSAYYRQLRENLKTAKIRVKESIDVLEELKILVDYDEKGYLLQIFTKPMQDRPTLFLEVIQRHNHQGFGAGNFNSLFKAFEEEQDLRGNLTDVETNGLVRGM

SEQ ID NO: 142 - protein, 390 aa, Choloepus didactylus
MTTYSNKGVKPERGQFLHFHSVTFWVGNAKQAASFYCNKMGFEPFAYKGLETGSREVVSHVIKQGKIVFVFSSALNPWNKEMGDHLVKHGDGVKDIAFEVEDCDYIVQKARERGAKIVRESWVEQDKFGKVKFAVLQTYGDTTHTLVEKMGYTGRFLPGFEAPAIKDPLLAKLPSCSLEVIDHIVGNQPDQEMVPVSDWYVKNLQFHRFWSVDDTQVHTEYSSLRSIVVANYEETIKMPINEPAQGRKKSQIQEYVDYNGGAGVQHIALKTQDITTTIRHLRERGLEFLAVPSTYYKQLREKLKTAKIRVKENIDVLEELKILVDYDEKGYLLQIFTKPVQDRPTLFLEVIQRHNHQGFGAGNFNSLFKAFEDEQNRRGNLTDLGTNGVP

SEQ ID NO: 143 - protein, 412 aa, Chlorocebus sabaeus
MCRQQSFFPGGSLHLRQQGQQAEGGQGLSSGSPPGWPLDPHEPCCNPVIQAVSFYCSKMGFEPLAYRGLETGSREVVSHVIKQGKIVFVLSSALNPWNKEMGDHLAKHGDGVKDIAFEVEDCDYIVQKARERGAKIVREPWVEQDKFGKVKFAVLQTYGDTTHTLVEKMNYTGQFLPGYEAPVFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITAIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLSDLETNGVVPGM

SEQ ID NO: 144 - protein, 393 aa, Chlorocebus sabaeus
MTTYSDKGAKPERGRFLHFHSVTFWVGNAKQAVSFYCSKMGFEPLAYRGLETGSREVVSHVIKQGKIVFVLSSALNPWNKEMGDHLAKHGDGVKDIAFEVEDCDYIVQKARERGAKIVREPWVEQDKFGKVKFAVLQTYGDTTHTLVEKMNYTGQFLPGYEAPVFMDPLLPKLPKCSLEIIDHIVGNQPDQEMVSASEWYLKNLQFHRFWSVDDTQVHTEYSSLRSIVVANYEESIKMPINEPAPGKKKSQIQEYVDYNGGAGVQHIALNTQDIITAIRHLRERGMEFLSVPSTYYKQLREKLKTAKIKVKENIDVLEELKILVDYDEKGYLLQIFTKPVQDRPTLFLEVIQRHNHQGFGAGNFNSLFKAFEEEQNLRGNLSDLETNGVVPGM

SEQ ID NO: 145 - protein, 393 aa, Arvicola amphibius
MTTYTNKGPKPERGRFLHFHSVTFWVGNAKQAASFYCNKMGFEPLAYRGLETGSREVVSHVIKQGKIVFVLCSALNPWNKEMGDHLVKHGDGVKDIAFEVEDCEHIVQKARERGAKIVREPWVEQDKFGKVKFAVLQTYGDTTHTLVEKINYTGRFLPGFEAPVYKDTLLPKLPRCNLEVIDHIVGNQPDQEMVSASEWYLKNLQFHRFWSVDDTQVHTEYSSLRSIVVANYEESIKMPINEPAPGKKKSQIQEYVDYNGGAGVQHIALKTDDIITAIRHLRERGMEFLAVPSSYYKLLRENLKTAKIQVKESLDVLEELKILVDYDEKGYLLQIFTKPMQDRPTLFLEVIQRHNHQGFGAGNFNSLFKAFEEEQALRGNLTDLETNGVRSGM

SEQ ID NO: 146 - protein, 393 aa, Tachyglossus aculeatus
MTTYTDKGEKPLRGQFLHFHSVTFWVGNAKQAASFYCNKMGFEPLAYRGLETGSREVVSHVIKQDKIIFIFSSALNPGNKEMGEHLVKHGDGVKDVAFQVEDCDFIVQKARERGAAIVKEPWVEQDKNGRVKFAVLQTYGDTTHTLIEKIDYKGPFLPGYEAPLFLDPLLPKLPACKLNFIDHVVGNQPDHEMVPAVEWYQKNLLFHRFWSVDDKQVHTDFSALRSIVVANYEETIKMPINEPALGKKKSQIQEYVEYYGGAGVQHIALNTQDIISAIAHLKERGTEFMSVPSTYYTQLREKLKTAKIRVKENIKQLEELKILVDYDEKGYLLQIFTKPMQDRPTLFLEVIQRHNHQGFGAGNFTSLFKAIEEDQQARGNLTVLSPNGEVSAM

SEQ ID NO: 147 - protein, 393 aa, Canis lupus familiaris
MTTYSDKGKKPERGRFLHFHSVTFWVGNAKQAASFYCNKMGFEPLAYKGLETGSREVVSHVIKQGKIVFVFSSALNPWNKEMGDHLVKHGDGVKDIAFEVEDCDYIVQKAREQGAKIMREPWIEEDKFGKVKLAVLQTYGDTTHTLVEKINYTGRFLPGFEAPACVDPLLSKLPSCSLEIIDHIVGNQPDQEMVSASEWYLKNLQFHRFWSVDDTQVHTEYSSLRSIVVANYEESIKMPINEPAPGKKKSQIQEYVDYNGGAGVQHIALKTQDIITAIRHLRDRGMEFLAVPSTYYKQLREKLKSAKIQVKESIDVLEELKILVDYDEKGYLLQIFTKPMQDRPTLFLEVIQRHNHQGFGAGNFNSLFKAFEEEQDLRGNLTDLETNGMMPGM

SEQ ID NO: 148 - protein, 393 aa, Eschrichtius robustus
MTTYSNKGQKPERGQFLHFHSVTFWVGNAKQAASYYCSKMGFEPLAYKGLETGSREMVSHVIKQGKIVFIFSSALNPWNKEMGDHLVKHGDGVKDIAFEVEDCDYIVQKARERGAKIVREPWVEQDKFGKVKFAVLQTYGDTTHTLVEKMNYTGWFLPGFEAPAFVDPLLSKLPNCSLEIIDHIVGNQPDQEMVSASEWYLKNLQFHRFWSVDDTQVHTEYSSLRSIVVANYEESIKMPINEPAPGRKKSQIQEYVDYNGGAGVQHIALKTEDIITAIHHLRERGMEFLAVPSTYYKQLREKLKTAKIRVKENIDVLEELKILVDYDEKGYLLQIFTKPMQDRPTLFLEVIQRYNHQGFGAGNFNSLFKAFEEEQDLRGNLTDMETNGLAPGM

SEQ ID NO: 149 - DNA, 1179 bp, Rattus norvegicus
atgaccacctactctaacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaagaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccatcttgtaacttggaaatcatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgagaaccgaagacatcatcaccaccatcagacacttgagagaaagaggtatggaattcttggctgttccatcttcttactacagattgttgagagaaaacttgaagacctctaagatccaagttaaggaaaacatggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaaccaacggtgttagatctggtatg

SEQ ID NO: 150 - DNA, 1131 bp, Rattus norvegicus
atgtactgggacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaagaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccatcttgtaacttggaaatcatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgagaaccgaagacatcatcaccaccatcagacacttgagagaaagaggtatggaattcttggctgttccatcttcttactacagattgttgagagaaaacttgaagacctctaagatccaagttaaggaaaacatggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggt

SEQ ID NO: 151 - DNA, 1062 bp, Rattus norvegicus
atgggtttcgaaccattggcttacaagggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaagaagacaagttcggtaaggttaagttcgctgttttgcaaacctacggtgacaccacccacaccttggttgaaaagatcaactacaccggtagattcttgccaggtttcgaagctccaagatacaaggacaccttgttgccaaagttgccatcttgtaacttggaaatcatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgagaaccgaagacatcatcaccaccatcagacacttgagagaaagaggtatggaattcttggctgttccaccatcttactacagattgttgagagaaaacttgaagtctgctaagatccaagttaaggaagacatggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaaccaacggtgttagatctggtatg

SEQ ID NO: 152 - DNA, 1182 bp, Yarrowia lipolytica
atgtctccatctgttgaagttaccccagctcacaccccaacctcttacgaagttaccaactctttggactcttacagaggttacgaccacgttcactggtacgttggtaacgctaagcaagctgcttctttctacatcaccagaatgggtttctctccaatcgcttacaagggtttggaaaccggttctagagacgttaccacccacgttgttggtaacggtcaagttagattcgctttctcttctgctttgagaaccggtgaaccacaagctgacgaaatccacgctcacttggttaagcacggtgacgctgttaaggacgttgctttcgaagttgacaacgttgaacaattgttctctgctgctgttaagaagggtgttagagttatctctgaaccaaaggttttgaaggacgctcacggttctgttacctacgctgttatctctacctacggtgacaccacccacaccttgatcgaaagaggttcttacgaaggtgctttcttgccaggtttcgttgacacctctgctaacaaggacccaatcgctgctttcttgccaaacatcgaattgatgcacatcgaccactgtgttggtaaccaagactggaacgaaatggacaacgcttgtaagtactacgaagaaaccttgggtttccacagattctggtctgttgacgacaaggacatctgtaccgaattctctgctttgaagtctgttgttatggcttctccaaacgaaaagatcaagatgccagttaacgaaccagctgttggtaagaagaagtctcaaatcgaagaatacatcgacttctacgacggtccaggtatccaacacatcgctttgagaaccgactgtatcttggacaccgttagagacttgagagctagaggtgttgaattcatctctgttccaggttcttactacgaaaacatgaaggaaagattggctaagtcttctttgaagttggaagaaaagttcgaagacatccaagctttgaacatcttgatcgacttcgacgaaggtggttacttgttgcaattgttcaccaagccattgatggacagaccaaccgttttcatcgaaatcatccaaagaagaaacttcgaaggtttcggtgctggtaacttcaagtctttgttcgaagctatcgaaagagaacaagctaagagaggtaacttg

SEQ ID NO: 153 - DNA, 1182 bp, Yarrowia lipolytica
atgtctccatctgttgaagttaccccagctcacaccccaacctcttacgaagttaccaactctttggactcttacagaggttacgaccacgttcactggtacgttggtaacgctaagcaagctgcttctttctacatcaccagaatgggtttctctccaatcgcttacaagggtttggaaaccggttctagagacgttaccacccacgttgttggtaacggtcaagttagattcgctttctcttctgctttgagaaccggtgaaccacaagctgacgaaatccacgctcacttggttaagcacggtgacgctgttaaggacgttgctttcgaagttgacaacgttgaacaattgttctctgctgctgttaagaagggtgttagagttatctctgaaccaaaggttttgaaggacgctcaaggttctgttacctacgctgttatctctacctacggtgacaccacccacaccttgatcgaaagaggttcttacgaaggtgctttcttgccaggtttcgttgacacctctgctaacaaggacccaatcgctgctttcttgccaaacatcgaattgatgcacatcgaccactgtgttggtaaccaagactggaacgaaatggacaacgcttgtaagtactacgaagaaaccttgggtttccacagattctggtctgttgacgacaaggacatctgtaccgaattctctgctttgaagtctgttgttatggcttctccaaacgaaaagatcaagatgccagttaacgaaccagctgttggtaagaagaagtctcaaatcgaagaatacatcgacttctacgacggtccaggtatccaacacatcgctttgagaaccgactgtatcttggacaccgttagagacttgagagctagaggtgttgaattcatctctgttccaggttcttactacgaaaacatgaaggaaagattggctaagtcttctttgaagttggaagaaaagttcgaagacatccaagctttgaacatcttgatcgacttcgacgaaggtggttacttgttgcaattgttcaccaagccattgatggacagaccaaccgttttcatcgaaatcatccaaagaagaaacttcgaaggtttcggtgctggtaacttcaagtctttgttcgaagctatcgaaagagaacaagctaagagaggtaacttg

SEQ ID NO: 154 - DNA, 1179 bp, Homo sapiens
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcatgagagaaccatgggttgaacaagacaagttcggtaaggttaagttcgctgttttgcaaacctacggtgacaccacccacaccttggttgaaaagatgaactacatcggtcaattcttgccaggttacgaagctccagctttcatggacccattgttgccaaagttgccaaagtgttctttggaaatgatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtttggaattcttgtctgttccatctacctactacaagcaattgagagaaaagttgaagaccgctaagatcaaggttaaggaaaacatcgacgctttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaaccaacggtgttgttccaggtatg

SEQ ID NO: 155 - DNA, 1131 bp, Homo sapiens
tggtactgggacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttgttaagcaaggtaagatcgttttcgttttgtgttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaagaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccatcttgtaacttggaaatcatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgagaaccgaagacatcatcaccaccatctgtcacttgagagaaagaggtatggaattcttggctgttccatcttcttactacagattgttgagagaaaacttgaagacctctaagatccaagttaaggaaaacatggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggt

SEQ ID NO: 156 - DNA, 1125 bp, Homo sapiens
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcatgagagaaccatgggttgaacaagacaagttcggtaaggttaagttcgctgttttgcaaacctacggtgacaccacccacaccttggttgaaaagatgaactacatcggtcaattcttgccaggttacgaagctccagctttcatggacccattgttgccaaagttgccaaagtgttctttggaaatgatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtttggaattcttgtctgttccatctacctactacaagcaattgagagaaaagttgaagaccgctaagatcaaggttaaggaaaacatcgacgctttggaagttagaccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaaccaacggtgttgttccaggtatg

SEQ ID NO: 157 - DNA, 1179 bp, Rattus norvegicus
atgaccacctacaccgacaagggtgaaaagccattgagaggtagattcatccacttccactctatcaccttctgggttggtaacgctaagcaagctgcttcttactactgtaacaagatgggtttcgaagaattggcttacagaggtttggaaaccggttctagagaagttgtttctcacgttatcaagcaagacaagatcgttttcgttttgtcttctgctttgaacccaggtaacgaagaaatgggtgaacacttggttaagcacggtgacggtgttaaggacatcgctttcgaagttgaagactgtgacttcatcgttcaaaaggctaaggaaagaggtgctgttgttgttaaggaaccatgggttgaagaagacaagttcggtaaggttaagttcgctgttatccaaacctacggtgacaccacccacaccttgatcgaaaagttgaactacaagggtttgttcttgccaggttaccacccaccattgttcaaggacccattgttgccaaagttgccatctgctaagttgaacttcgttgaccacgttgttggtaaccaaccagacttgcaaatggttccagttgctgactggtaccaaaagaacttgttgttccacagattctggtctgttgacgacaagcaattgcacaccgaattctctgctttgagatctatcgttgttaccaactacgaagaaaccatcaagatgccaatcaacgaaccagctttcggtaagaagaagtctcaaatccaagaatacgttgactactacggtggtgctggtgttcaacacatcgctttgaacacctctgacatcatctctgctatcaccaacttgaagcaaagaggtatgcaattcatggacgttccatcttcttactaccaaatgttgagagaaagattgaagaccgctaagatcaaggttaaggaaaacatcgacaagttggctgaattgaagatcttggttgacttcgacgaaaagggttacttgttgcaaatcttcaccaagccagttcaagacagaccaaccgttttcttggaagttatccaaagacacaaccaccaaggtttcggtgctggtaacttcaagtctttgttcgaagctatcgaaatcgaccaagacgctagaggtaacttgaccatcttggaaccaaacggtgaaaccaagagaatc

SEQ ID NO: 158 - DNA, 1179 bp, Mus musculus domesticus
caaaccacctacaccgacaagggtgaaaagccattgagaggtagattcatccacttccactctatcaccttctgggttggtaacgctaagcaagctgcttcttactactgtaacaagttgggtttcgaagaattggcttacagaggtttggaaaccggttctagagaagttgtttctcacgttatcaagcaagacaagatcgttttcgttttgtcttctgctttgaacccaggtaacgaagaaatgggtgaacacttggttaagcacggtgacggtgttaaggacatcgctttcgaagttgaagactgtgacttcatcgttcaaaaggctagagaaagaggtgctgttgttgttaaggaaccatgggttgaagaagacaagttcggtaaggttaagttcgctgttatccaaacctacggtgacaccacccacaccttggttgaaaagttgaactacaagggtttgttcttgccaggttaccaccaaccattgttcaaggacccattgttgccaaagttgccatctgctaagttgtctttcgttgaccacgttgttggtaaccaaccagacttgcaaatggttccagttgctgactggtaccaaaagaacttgttgttccacagattctggtctgttgacgacaagcaattgcacaccgaattctctgctttgagatctatcgttgttaccaactacgaagaaaccatcaagatgccaatcaacgaaccagctttcggtaagaagaagtctcaaatccaagaatacatcgactactacggtggtgctggtgttcaacacatcgctttgaacacctctgacatcatctctgctatcaccaacttgaagcaaagaggtatgcaattcatggacgttccatcttcttactaccaagttttgagagaaagattgaagaccgctaagatcaaggttaaggaaaacatcgacaagttggctgaattgaagatcttggttgacttcgacgaaaagggttacttgttgcaaatcttcaccaagccagttcaagacagaccaaccgttttcttggaagttatccaaagacacaaccaccaaggtttcggtgctggtaacttcaagtctttgttcgaagctatcgaaatggaccaagacgctagaggtaacttgaccatcttggaaccaaacggtgaaaccaagagaatc

SEQ ID NO: 159 - DNA, 1179 bp, Mus musculus
atgaccacctacaccgacaagggtgaaaagccagaaggtggtaagttcttgcacttccactctttgaccttctgggttggtaacgctaagcaagctgcttctttctactgtaacaagatgggtttcgaagaattggcttacaagggtttggaaaccggttctagagaagttgtttctcacgttatcaagcaagacaagatcatcttcgttttgtcttctgctttgaacccagaaaacaaggacatgggtgaacacttggttaagcacggtgacggtgttaaggacatcgctttcgaagttgaagactgtgacttcatcgttcaaaaggctaaggaaagaggtgctgttatcgttaaggaaccatgggttgaagaagacaagtacggtaaggttaagttcgctgttatccaaacctacggtgacaccacccacaccttgatcgaaaacttgaactacaagggtttgttcttgccaggtttcgaaccaccattgttcaaggacccattgttgccaaagttgccatctggtaagttgtctttcatcgaccacgttgttggtaaccaaccagacttgcaaatggttccagttgctgaatggtaccaaaagaacttgttgttccacagattctggtctgttgacgacaagcaattgcacacccaattctctgctttgagatctatcgttgttgctaactacgaagaaaccatcaagatgccaatcaacgaaccagctgttggtaagaagaagtctcaaatccaagaatacgttgaatactacggtggtgctggtgttcaacacatcgctttgaacaccccagacatcatcaccgctgttaccaacttgaagcaaagaggtatcgaattcatgaccgttccatctacctactaccaacaattgagagaaaagttgaagtctgctaagatcaaggttaaggaaaacatcgacaagttggaagaattgaagatcttggttgacttcgacgaaaagggttacttgttgcaaatcttcaccaagccagttcaagacagaccaaccgttttcttggaagttatccaaagacacaaccaccaaggtttcggtgctggtaacttcaagtctttgttccaagctatcgaagacgaccaagacgctagaggtaacttgaccatcttgaccgctaacggtgaaaccaacttcatc

SEQ ID NO: 160 - DNA, 1179 bp, Homo sapiens
atgaccacctacaccgacaagggtgaaaagccagaaggtggtaagttcttgcacttccactctttgaccttctgggttggtaacgctaagcaagctgcttctttctactgtaacaagatgggtttcgaagaattggcttacaagggtttggaaaccggttctagagaagttgtttctcacgttatcaagcaagacaagatcatcttcgttttgtcttctgctttgaacccagaaaacaaggaaatgggtgaacacttggttaagcacggtgacggtgttaaggacatcgctttcgaagttgaagactgtgacttcatcgttcaaaaggctaaggaaagaggtgctgttatcgttaaggaaccatgggttgaagaagacaagtacggtaaggttaagttcgctgttatccaaacctacggtgacaccacccacaccttgatcgaaaacttgaactacaagggtttgttcttgccaggtttcgaattgccattgttcaaggacccattgttgccaaagttgccatctggtaagttgtctttcatcgaccacgttgttggtaaccaaccagacttgcaaatggttccagttgctgaatggtaccaaaagaacttgttgttccacagattctggtctgttgacgacaagcaattgcacacccaattctctgctttgagatctatcgttgttgctaactacgaagaaaccatcaagatgccaatcaacgaaccagctgttggtaagaagaagtctcaaatccaagaatacgttgaatactacggtggtgctggtgttcaacacatcgctttgaacaccccagacatcatcaccgctgttaccaacttgaagcaaagaggtatggaattcatgaccgttccatctacctactaccaacaattgagagaaaagttgaagtctgctaagatcaaggttaaggaaaacatcgacaagttggaagaattgaagatcttggttgacttcgacgaaaagggttacttgttgcaaatcttcaccaagccagttcaagacagaccaaccgttttcttggaagttatccaaagacacaaccaccaaggtttcggtgctggtaacttcaagtctttgttccaagctatcgaagacgaccaagacgctagaggtaacttgaccatcttgaccgctaacggtgaaaccaacttcatc

SEQ ID NO: 161 - DNA, 1179 bp, Rattus norvegicus
atgaccacctacaccgacaagggtgaaaagccagaaggtggtaagttcttgcacttccactctttgaccttctgggttggtaacgctaagcaagctgcttctttctactgtaacaagatgggtttcgaagaattggcttacaagggtttggaaaccggttctagagaagttgtttctcacgttatcaagcaagacaagatcatcttcgttttgtcttctgctttgaacccagaaaacaaggaaatgggtgaacacttgttgaagcacggtgacggtgttaaggacatcgctttcgaagttgaagactgtgacttcatcgttcaaaaggctaaggaaagaggtgctgttatcgttaaggaaccatgggttgaagaagacaagtacggtaaggttaagttcgctgttatccaaacctacggtgacaccacccacaccttgatcgaaaacttgaactacaagggtttgttcttgccaggtttcgaaccaccattgttcaaggacccattgttgccaaagttgccatctggtaagttgtctttcatcgaccacgttgttggtaaccaaccagacttgcaaatggttccagttgctgaatggtaccaaaagaacttgttgttccacagattctggtctgttgacgacaagcaattgcacacccaattctctgctttgagatctatcgttgttgctaactacgaagaaaccatcaagatgccaatcaacgaaccagctatgggtaagaagaagtctcaaatccaagaatacgttgaatactacggtggtgctggtgttcaacacatcgctttgaacaccccagacatcatcaccgctgttaccaacttgaagcaaagaggtatggaattcatgaccgttccatctacctactaccaacaattgagagaaaagttgaagtctgctaagatcaaggttaaggaaaacatcgacaagttggaagaattgaagatcttggttgacttcgacgaaaagggttacttgttgcaaatcttcaccaagccagttcaagacagaccaaccgttttcttggaagttatccaaagacacaaccaccaaggtttcggtgctggtaacttcaagtctttgttccaagctatcgaagacgaccaagacgctagaggtaacttgaccatcttgaccgctaacggtgaaaccaacttcatc

SEQ ID NO: 162 - DNA, 1179 bp, Mus musculus
atgaccacctacaccgacaagggtgaaaagccagaaggtggtaagttcttgcacttccactctttgaccttctgggttggtaacgctaagcaagctgcttctttctactgtaacaagatgggtttcgaagaattggcttacaagggtttggaaaccggttctagagaagttgtttctcacgttatcaagcaagacaagatcatcttcgttttgtcttctgctttgaacccagaaaacgaagaaatgggtgaacacttggttaagcacggtgacggtgttaaggacatcgctttcgaagttgaagactgtgacttcatcgttcaaaaggctaaggaaagaggtgctgttatcgttaaggaaccatgggttgaagaagacaagtacggtaaggttaagttcgctgttatccaaacctacggtgacaccacccacaccttgatcgaaaacttgaactacaagggtttgttcttgccaggtttcgaaccaccattgttcaaggacccattgttgccaaagttgccatctggtaagttgtctttcatcgaccacgttgttggtaaccaattggacttgcacatggttccagttgctgaatggtaccaaaagaacttgttgttccacagattctggtctgttgacgacaagcaattgcacacccaattctcttctttgagatctatcgttgttgctaactacgaagaaaccatcaagatgccaatcaacgaaccagctatgggtatgaagaagtctcaaatccaagaatacgttgaatactacggtggtgctggtgttcaacacatcgctttgaacacctctgacatcatcaccgctgttaccaacttgaagcaaagaggtatggaattcatggttgttccatctacctactaccaacaattgagagaaaagttgaagtctgctaagatcaaggttaaggaaaacatcgacaagttggaagaattgaagatcttggttgacttcgacggtaagggttacttgttgcaaatcttcaccaagccagttcaagacagaccaaccgttttcttggaagttatccaaagacacaaccaccaaggtttcggtgctggtaacttcaagtctttgttccaagctatcgaagacgaccaagacgctagaggtaacttgaccatcttgaccgctaacggtgaaaccaactcttgt

SEQ ID NO: 163 - DNA, 1179 bp, Bos taurus
atgaccacctacaccgacaagggtcaaaagccagaaagaggtagattcttgcacttccactctatcaccttctgggttggtaacgctaagcaagctgcttcttactactgtaacaagatgggtttcgaagaaatggcttacagaggtttggaaaccggttctagagaagttgtttctcacgttatcagacaagacaagatcgttttcgttttgtcttctgctttgaacccaggtaacgaagaaatgggtgctcacttggttaagcacggtgacggtgttaaggacgttgctttcgaagttgaagactgtgacttcatcgttcaagaagctagagaaagaggtgctgctatcgttaaggaaccatgggttgaagaagacaagcacggtagagttaagttcgctgttatccaaacctacggtgacaccacccacaccttggttgaaaagttgaactacggtggtttgttcttgccaggtttcgaagctccattgttcaaggaccaattgttgccaaagttgccatctaccaagttgagattcatcgaccacgttgttggtaaccaaccagacttggaaatggttccagttgctgaatggtaccaaagaaacttgttgttccacagattctggtctgttgacgacaagcaattgcacaccgaattctctgctttgagatctatcgttgttgctaactacgaagaaaccatcaagatgccaatcaacgaaccagctgttggtaagaagaagtctcaaatccaagaatacatcgactactacggtggtccaggtgttcaacacatcgctttgaacacctctgacatcatctctgctatcaccaacttgaagcaaagaggtatggaattcatgtctgttccagctacctactaccaacaattgagacaaagattgaagaccgctaagatcgaagttaaggaatctatcgacaagttggaagaattgaagatcttggttgacttcgacgaaaagggttacttgttgcaaatcttcaccaagccagttcaagacagaccaaccttgttcttggaagttatccaaagatacaaccaccaaggtttcggtgctggtaacttcaagtctttgttcgaagctatcgaagctgaccaagacgctagaggtaacttgaccttgttgacctctaacgttgaaaacaacttcatc

SEQ ID NO: 164 - DNA, 1179 bp, Mus musculus
atgaccacctacaccgacaagggtgaaaagccattgagaggtcaattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaagacaagatcatcttcatcttctcttctgctttgaacccaggtaacaaggaaatgggtgaacacttggttaagcacggtgacggtgttaaggacgttgctttccaagttgaagactgtgacttcatcgttcaaaaggctagagaaagaggtgctgctatcgttaaggaaccatgggttgaacaagacaagaacggtagagttaagttcgctgttttgcaaacctacggtgacaccacccacaccttgatcgaaaagatcgactacaagggtccattcttgccaggttacgaagctccattgttcttggacccattgttgccaaagttgccagcttgtaagttgaacttcatcgaccacgttgttggtaaccaaccagaccacgaaatggttccagctgttgaatggtaccaaaagaacttgttgttccacagattctggtctgttgacgacaagcaagttcacaccgacttctctgctttgagatctatcgttgttgctaactacgaagaaaccatcaagatgccaatcaacgaaccagctttgggtaagaagaagtctcaaatccaagaatacgttgaatactacggtggtgctggtgttcaacacatcgctttgaacacccaagacatcatctctgctatcgctcacttgaaggaaagaggtaccgaattcatgtctgttccatctacctactacacccaattgagagaaaagttgaagaccgctaagatcagagttaaggaaaacatcaagcaattggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcacctctttgttcaaggctatcgaagaagaccaacaagctagaggtaacttgaccgttttgtctccaaacggtgaagtttctgctatg

SEQ ID NO: 165 - DNA, 1179 bp, Homo sapiens
atgacctcttacaccgacagaggtcaaaagccaccaagaggtagattcttgcacttccactctatcaccttctgggttggtaacgctaagcaagctgcttctttctactgtcacaagatgggtttctctccattcgcttacagaggtttggaaaccggttctagagacgttgcttctcacgttgttaagcaaggtaagatcatcttcatcttctcttctgctttgaacccaggtaacaaggaaatgggtgaccacttggttaagcacggtgacggtgttaaggacatctctttcgaagttgaagactgtgactacatcgttcaaaaggctagagaaagaggtgctatcatcgttaaggaaccatggaccgaacaagacaagttcggttgggttaagttcgctgttttgcaaacctacggtgacaccacccacaccttggttgaaaagttgaactacaccggtccattcttgccaggtttcgaagctccattgttcgaagacccattgttgccaaccttgccagactgtaagttggctatgatcgaccacgttgttggtaaccaaccagaccaagaaatggttccagctgctgactggtacaagaagaacttgatgttccacagattctggtctgttgacgacaagcaagttcacaccgaattctcttctttgagatctatcgttatggctaactacgaagaaaccatcaagatgccaatcaacgaaccagctatgggtagaaagaagtctcaaatccaagaatacgttgactactacggtggtgctggtgttcaacacatcgctatgtctaccccagacatcatctctgctatcacctacttgagagctagaggtttggaattcttgtctgttccatctacctactacaagcaattgagagaaggtttgaagtctgctaagatccaagttaaggaatctatcgacaccttggaagaattgaagatcttggttgactacgacgaaaagggttacttgttgcaaatcttcaccaagccagttcaagacagaccaaccgttttcttggaagttatccaaagacacaaccaccaaggtttcggtgctggtaacttcaactctttgttcaaggctttcgaagaagaacaaaacatcagaggtaacttgaccgacttggctccaaacggtttgggtatcgttatg

SEQ ID NO: 166 - DNA, 1179 bp, Pan troglodytes
atgacctcttacaccgacagaggtgaaaagccaccaagaggtagattcttgcacttccactctatcaccttctgggttggtaacgctaagcaagctgcttctttctactgtcacaagatgggtttctctccattggcttacagaggtttggaaaccggttctagagaagttgcttctcacgttgttaagcaaggtaagatcatcttcatcttctcttctgctttgaacccaggtaacaaggaaatgggtgaccacttggttaagcacggtgacggtgttaaggacatctctttcgaagttgaagactgtgactacatcgttcaaaaggctagagaaagaggtgctatcatcgttaaggaaccatggatcgaacaagacaagttcggttgggttaagttcgctgttttgcaaacctacggtgacaccacccacaccttggttgaaaagttgaactacaccggtccattcttgccaggtttcgaagctccattcttcgaagacccattgttgccaaccttgccagactgtaagttggctatgatcgaccacgttgttggtaaccaaccagaccaagaaatggttccaatcgctgactggtacaagaagaccttgatgttccacagattctggtctgttgacgacaagcaagttcacaccgaattctcttctttgagatctatcgttatggctaactacgaagaaaccatcagaatgccaatcaacgaaccagctatgggtagaaagaagtctcaaatccaagaatacgttgactactacggtggtgctggtgttcaacacatcgctatgtctaccaccgacatcatctctgctatcacccacttgagagctagaggtatggaattcttgaacgttccatctacctactacaagcaattgagagaaagattgaagtctgctaagatccaagttaaggaaaacatggacatcttggaaaagttgaagatcttggttgactacgacgaaaagggttacttgttgcaaatcttcaccaagccagttcaagacagaccaaccgttttcttggaagttatccaaagacacaaccaccaaggtttcggtgctggtaacttcaactctttgttcaaggctttcgaagaagaacaaaacatcagaggtaacttgaccgacttggctccagacggtttgggtaccgttatg

SEQ ID NO: 167 - DNA, 1179 bp, Cricetulus griseus
atgaccacctacaccgacagaggtgaaaagccaccaagaggtagattcttgcacttccactctatcaccttctgggttggtaacgctaagcaagctgcttctttctactgtaacaagatgggtttctctccattggcttacagaggtttggaaaccggttctagagaagttgcttctcacgttgttaagcaaggtaagatcatcttcatcttctcttctccattgaacccaggtaacaaggaaatgggtgaccacttggttaagcacggtgacggtgttaaggacatctctttcgaagttgaagactgtgactacatcgttcaaaaggctagagaaagaggtgctgttatcgttaaggaaccatggatcgaacaagacaagttcggtagagttaagttcgctatcttgcaaacctacggtgacaccacccacaccttggttgaaaagttgaactacaccggtccattcttgccaggtttcgaaaccccaagattcttggacccattgttgccaaagttgccagactgtaagttggctatgatcgaccacgttgttggtaaccaaccagaccaagaaatggttaccgctgctgaatggtacaagaagaacttgttgttccacagattctggtctgttgacgacaagcaagttcacaccgaattctcttctttgagatctatcgttatggctaactacgaagaaaccatcaagatgccaatcaacgaaccagctatgggtagaaagaagtctcaaatccaagaatacgttgactactacggtggtgctggtgttcaacacatcgctatgtctaccccagacatcatctctgctatcacccacttgaaggctagaggtatggaattcttgtctgctccagctacctactacaagcaattgagagaaggtttgaaggctgctaagatgcaagttaaggaaaacatcgacaagttggaagaattgaagatcttggttgactacgacgaaaagggttacttgttgcaaatcttcaccaagccagttcaagacagaccaaccgttttcttggaagttatccaaagacacaaccaccaaggtttcggtgctggtaacttcaacgctttgttcaaggctttcgaagaagaacaatctgttagaggtaacttgaccgacttggctccaaacggtgttggtatcgctatg

SEQ ID NO: 168 - DNA, 1179 bp, Saimiri boliviensis boliviensis
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttgttaagcaaggtaagatcgttttcgttttctcttctgctttgaacccatggaacaaggaaatgggtgaccacttggttaagcacggtgacggtgttaaggacgttgctttcgaagttgaagactgtgactacatcgttcaaaaggctagagaaagaggtgctaagatcgttcaagaaccatgggttgaagaagacaagttcggtaaggttaagttcgctgttttgcaaacctacggtgacaccacccacaccttggttgaaaagaccaactacaccggtagattcttgccaggtttcgaagctccattgttgaaggactctttgttgccaaagttgccaaagtgtggtttggaaatcatcgaccacgttgttggtaaccaaccagaccaagaaatgttgtctgcttctgaatggtacttgagaaacttgcaattccacagattctggtctgttgacgacacccaagttcacaccgaatactcttctttgagatctatcgttgttaccaactacgaagaaaccatcaagatgccaatcaacgaaccagctatgggtagaaagaagtctcaaatccaagaatacgttgactacaacggtggtgctggtgttcaacacatcgctttgaagacccaagacatcatcaccgctatcagatctttgagagacagaggtttggaattcttgtctgttccatctacctactacaagcaattgagagaaaacttgaagaccgctaagatcagagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctatcagaggtaacttgaccgacttggaaatcaagggtgaagtttctggtatg

SEQ ID NO: 169 - DNA, 1152 bp, Felis catus
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttgttaagcaaggtaagatcgttttcgttttctcttctgctttgaacccatggaacaaggaaatgggtgaccacttggttaagcacggtgacggtgttaaggacgttgctttcgaagttgaagactgtgactacatcgttcaaaaggctagagaacaaggtgctaagatcgttagagaaccatgggttgaagaagacaagttcggtaaggttaagttcgctgttttgcaaaccttcggtgacaccacccacaccttggttgaaaagaccaactactctggtagattcttgccaggtttcaaggctccattgttgaaggactctttgttgccaaagttgccaagatgtggtttggaaatcatcgaccacgttgttggtaacttgttggaccacgaaatgtcttctgcttctgaatggtacttgagaaacttgcaattccacagattctggtctgttgacgacacccaagttcacaccgaatactcttctttgagatctatcgttgttaccaactacgaagaaaccatcaagatgccaatcaacgaaccagctatgggtatgaagaagtcttctatccaagaatacgttgactacaacggtggtgctggtgttcaacacgttggtttgaagacccaagacatcatcaccaccatcagaaacttgcaagaaagaggtatggaattcttgaccgttccatctacctactacaagcaattgagagaaaacttgaagaccgctaagatcagagttaaggaatctatcgacgttttggaagaattgcaaatcttgatggactacgacgaaaagggttacatcttgcaaatcttcaccaagccaatgcaagacagaccaaccttgttcttggaagttatccaaagacacaaccaccaaggtttcggtgctggtaacttcaactctttgttcaaggctttggaagacgctcaagaattgagaggtaacttgaccaacttg

SEQ ID NO: 170 - DNA, 1152 bp, Ovis aries
atgaccacctacaccgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttgttaagcaaggtaagatcgttttcgttttctcttctgctttgaacccatggaacaaggaaatgggtgaccacttggttaagcacggtgacggtgttaaggacgttgctttcgaagttgaagactgtgactacatcgttcaaaaggctagagaaagaggtgctaaggttgttagagaaccatgggttgaagaagacaagttcggtaaggttaagttcgctgttttgcaaaccttcggtgacaccacccacaccttggttgaaaagaccaactactctggtagattcttgccaggtttccaagctccattgttgaaggactctttgttgccaaagttgccaaagtgtggtttggaaatcatcgaccacgttgttggtaacttgttggaccacgaaatgttgtctgcttctgaatggtacttgagaaacttgcaattccacagattctggtctgttgacgacacccaagttcacaccgaatactcttctttgagatctatcgttgttaccaactacgaagaaaccatcaagatgccaatcaacgaaccagctatgggtatgaagaagtcttctatccaagaatacgttgactacaacggtggtgctggtgttcaacacgttggtttgaagacccaagacatcatcaccaccatcagaaacttgcaagaaagaggtatggaattcttgaccgttccatctacctactacaagcaattgagagaaaacttgaagaccgctaagatccaagttaaggaatctatcgacgttttggaagaattgcaaatcttgatggactacgacgaaaagggttacatcttgcaaatcttcaccagaccaatgcaagacagaccaaccttgttcttggaagttatccaaagacacaaccaccaaggtttcggtgctggtaacttcaactctttgttcaaggctttggaagacgctcaagaattgagaggtaacttgaccaacttg

SEQ ID NO: 171 - DNA, 1152 bp, Orcinus orca
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttgttaagcaaggtaagatcgttttcgttttctcttctgctttgaacccatggaacaaggaaatgggtgaccacttggttaagcacggtgacggtgttaaggacgttgctttcgaagttgaagactgtgactacgttgttcaaaaggctagagaaagaggtgctaagatcgttagagaaccatgggttgaagaagacaagttcggtaaggttaagttcgctgttttgcaaaccttcggtgacaccacccacaccttggttgaaaagaccaactactctggtcaattcttgccaggtttcaaggctccattgttgaaggactctttgttgccaaagttgccaagatgtggtttggaaatcatcgaccacgttgttggtaacttgccagaccaagaaatgttgtctgcttctgaatggtacttgagaaacttgcaattccacagattctggtctgttgacgacacccaagttcacaccgaatactcttctttgagatctatcgttgttaccaactacgaagaaaccatcaagatgccaatcaacgaaccagctatgggtatgaagaagtcttctatccaagaatacgttgactacaacggtggtgctggtgttcaacacgttggtttgaagacccaagacatcatcaccaccatcagaaacttgcaagaaagaggtatggaattcttgaccgttccatctacctactacaagcaattgagagaaaacttgaagaccgctaagatcagagttaaggaatctatcgacgttttggaagaattgcaaatcttgatggactacgacgaaaagggttacatcttgcaaatcttcaccaagccaatgcaagacagaccaaccttgttcttggaagttatccaaagacacaaccaccaaggtttcggtgctggtaacttcaactctttgttcaaggctttggaagacgctcaagaattgagaggtaacttgaccaacttg

SEQ ID NO: 172 - DNA, 1170 bp, Odobenus rosmarus divergens
atgaccacctactctaacaagggtgttaagccagaaagaggtcaattcttgcacttccactctgttaccttctgggttggtaacgctaagcaagctgcttctttctactgtaacaagatgggtttcgaaccattcgcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaatcttgggttgaacaagacaagttcggtaaggttaagttcgctgttttgcaaacctacggtgacaccacccacaccttggttgaaaagatgggttacaccggtagattcttgccaggtttcgaagctccagctatcaaggacccattgttggctaagttgccatcttgttctttggaagttatcgaccacatcgttggtaaccaaccagaccaagaaatggttccagtttctgactggtacgttaagaacttgcaattccacagattctggtctgttgacgacacccaagttcacaccgaatactcttctttgagatctatcgttgttgctaactacgaagaaaccatcaagatgccaatcaacgaaccagctcaaggtagaaagaagtctcaaatccaagaatacgttgactacaacggtggtgctggtgttcaacacatcgctttgaagacccaagacatcaccaccaccatcagacacttgagagaaagaggtttggaattcttggctgttccatctacctactacaagcaattgagagaaaagttgaagaccgctaagatcagagttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagacgaacaaaacagaagaggtaacttgaccgacttgggtaccaacggtgttcca

SEQ ID NO: 173 - DNA, 1179 bp, Dasypus novemcinctus
atgaccacctactctgacaagggtgttaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttgttaagcaagacaagatcgttttcgttttgtcttctgctttgaacccaggtaacaaggaaatgggtgaccacttggttaagcacggtgacggtgttaaggacatcgctttcgaagttgaagactgtgcttctatcgttcaaaaggctagagaaagaggtgctaagatcgttagagaaccatgggttgaagaagacaagttcggtaaggttaagttcgctgttttgcaaacctacggtgacaccacccacaccttggttgaaaagatgaactacaccggtagattcttgccaggtttcgaagctccagttatcaccgacccattgttggctaagttgccatcttgtagattggaaatcatcgaccacatcgttggtaaccaaccagaccaagaaatggtttctgcttctgaatggtacgttaagaacttgcaattccacagattctggtctgttgacgacacccaagttcacaccgaatactcttctttgagatctatcgttgttgctaactacgaagaaaccatcaagatgccaatcaacgaaccagctcaaggtaagaagaagtctcaaatccaagaatacgttgactacaacggtggtgctggtgttcaacacatcgctttgaagacccaagacatcatcaccgctatcagacacttgaaggaaagaggtttggaattcttggctgttccatctacctactacagacaattgagagaaaagttgaagaccgctaagatcaaggttaaggaatctatcgacatcttggaagaattgaagatcttggttgacttcgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaagttgagaggtaacttgaccgacttgggtgctaacggtgttttgccaggtatg

SEQ ID NO: 174 - DNA, 1275 bp, Jaculus jaculus
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcaccttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagctttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatctctgcttcttggcaaccaagagaaggtcaaggtggtagacaaagatctggtaccgaagaaccaagagttccagctttgtgtcaagaaggttctcac

SEQ ID NO: 175 - DNA, 1182 bp, Mustela putorius furo
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcaccttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagctttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatgcaa

SEQ ID NO: 176 - DNA, 1182 bp, Heterocephalus glaber
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacttgaccttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagctttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatgcaa

SEQ ID NO: 177 - DNA, 1221 bp, Microtus ochrogaster
atgccattcgaaggtcaattgcacttgatcgactctttgaccaagaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcaccttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagttttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctgttgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatg

SEQ ID NO: 178 - DNA, 1179 bp, Chinchilla lanigera
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcaccttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagttttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctgttgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatg

SEQ ID NO: 179 - DNA, 1179 bp, Macaca fascicularis
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagttttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatg

SEQ ID NO: 180 - DNA, 1179 bp, Equus caballus
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagttttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagacaaagaggtatggaattcttgtctgttccatctacctactacaagcaattgagagaaaagttgaagaccgctaagatcaaggttaaggaaaacatcgaagttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatg

SEQ ID NO: 181 - DNA, 1179 bp, Bos mutus
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagttttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagacaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatg

SEQ ID NO: 182 - DNA, 1179 bp, Vicugna pacos
atgaccacctactctgacaagggtgctaagccagaaagaggtagattcttgcacttccactctgttaccttctgggttggtaacgctaagcaagctgtttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggctaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagttttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgtctgacttggaaaccaacggtgttgttccaggtatg

SEQ ID NO: 183 - DNA, 1179 bp, Myotis davidii
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagttttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatg

SEQ ID NO: 184 - DNA, 1179 bp, Leptonychotes weddellii
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagttttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccaccatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatg

SEQ ID NO: 185 - DNA, 1179 bp, Peromyscus maniculatus bairdii
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcatgagagaaccatgggttgaacaagacaagttcggtaaggttaagttcgctgttttgcaaacctacggtgacaccacccacaccttggttgaaaagatgaactacatcggtcaattcttgccaggttacgaaccaccagctttcatggacccattgttgccaaagttgccaaagtgttctttggaaatgatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtttggaattcttgtctgttccatctacctactacaagcaattgagagaaaagttgaagaccgctaagatcaaggttaaggaaaacatcgacgctttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaaccaacggtgttgttccaggtatg

SEQ ID NO: 186 - DNA, 1179 bp, Panthera tigris altaica
atgaccacctactctgacaagggtgctaagccagaaagaggtagattcttgcacttccactctgttaccttctgggttggtaacgctaagcaagctacctctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcatgagagaaccatgggttgaacaagacaagttcggtaaggttaagttcgctgttttgcaaacctacggtgacaccacccacaccttggttgaaaagatgaactacatcggtcaattcttgccaggttacgaagctccagctttcatggacccattgttgccaaagttgccaaagtgttctttggaaatgatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtttggaattcttgtctgttccatctacctactacaagcaattgagagaaaagttgaagaccgctaagatcaaggttaaggaaaacatcgacgctttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaaccaacggtgttgttccaggtatg

SEQ ID NO: 187 - DNA, 1179 bp, Physeter catodon
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacatcggtcaattcttgccaggttacgaagctccagctttcatggacccattgttgccaaagttgccaaagtgttctttggaaatgatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtttggaattcttgtctgttccatctacctactacaagcaattgagagaaaagttgaagaccgctaagatcaaggttaaggaaaacatcgacgctttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaaccaacggtgttgttccaggtatg

SEQ ID NO: 188 - DNA, 1179 bp, Bubalus bubalis
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacatcggtcaattcttgccaggttacgaagctccagctttcatggacccattgttgccaaagttgccaaagtgtagattggaaatgatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtttggaattcttgtctgttccatctacctactacaagcaattgagagaaaagttgaagaccgctaagatcaaggttaaggaaaacatcgacgctttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaaccaacggtgttgttccaggtatg

SEQ ID NO: 189 - DNA, 1179 bp, Balaenoptera acutorostrata scammoni
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacatcggtcaattcttgccaggttacgaagctccagctttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtttggaattcttgtctgttccatctacctactacaagcaattgagagaaaagttgaagaccgctaagatcaaggttaaggaaaacatcgacgctttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaaccaacggtgttgttccaggtatg

SEQ ID NO: 190 - DNA, 1179 bp, Lipotes vexillifer
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatggatcgaacaagacaagttcggtaaggttaagttcgctgttttgcaaacctacggtgacaccacccacaccttggttgaaaagatgaactacatcggtcaattcttgccaggttacgaagctccagctttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtttggaattcttgtctgttccatctacctactacagacaattgagagaacaattgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaacctctggtgttgttccaggtatg

SEQ ID NO: 191 - DNA, 1179 bp, Carlito syrichta
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacatcggtcaattcttgccaggttacgaagctccagctttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtttggaattcttgtctgttccatctacctactacagacaattgagagaacaattgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaacctctggtgttgttccaggtatg

SEQ ID NO: 192 - DNA, 1179 bp, Oryctolagus cuniculus
atgaccacctactctgacaagggtgctaagccagaaagaggtagattcttgcacttccactctgttaccttctgggttggtaacgctaagcaagctgcttctttctactgtaccaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcaccttcgaagttgaagactgtgactacatcgttcaaaaggctagagaaagaggtgctaagatcgttcaagaaccatgggttgaagaagacaagttcggtaaggttaagttcgctgttttgcaaaccttcggtgacatcacccacaccttggttgaaaagatgtcttacgctggtagattcttgccaggttacgaagctccagttttcatggacccattgttgccacaattgccaaagtgttctttgaaggttatcgaccacatcgttggtaaccaaccagaccaagaaatggcttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgaatacaacggtggtgctggtgttcaacacatcgctttgaagacccaagacatcatcaccgctatcagacacttgagagaaagaggtttggaattcttgtctgttccatctacctactacaagcaattgagagaaaagttgaaggttgctaagatcaaggttaaggaatctatcgacgttttggaagaattgaagatcttggttgacttcgacgaaaagggttacttgttgcaaatcttcaccaagccagttcaagacagaccaaccttgttcttggaagttatccaaagacacaaccaccaaggtttcggtgctggtaacttcaactctttgttcaaggctatcgaagaagaacaaaacttgagaggtaacttgaccaacagagaaaccgacggtgttgttccaggtatg

SEQ ID NO: 193 - DNA, 1179 bp, Galeopterus variegatus
atgaccacctactctgacaagggtgctaagccagaaagaggtagattcttgcacttccactctgttaccttctgggttggtaacgctaagcaagctgcttctttctactgtaccaagatgggtttcgaaccattggcttacagaggtttggaaaccggttctagagaagttgtttctcacgttatcaagcaaggtaagatcgttttcgttttgtcttctgctttgaacccatgggacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaagaagacaagttcggtaaggttaagttcgctgttttgcaaacctacggtgacaccacccacaccttggttgaaaagatgaactacgctggtagattcttgccaggttacgaagctccagttttcatggacccattgttgccacaattgccaaagtgttctttggaagttatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagaaagaggtatggaattcttgtctgttccatctacctactacaagcaattgagagaaaagttgaaggttgctaagatcaaggttaaggaatctatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaaccgacggtgttgttccaggtatg

SEQ ID NO: 194 - DNA, 1179 bp, Nannospalax galili
atgaccacctactctgacaagggtgctaagccagaaagaggtagattcttgcacttccactctgttaccttctgggttggtaacgctaagcaagctgcttctttctactgtaccaagatgggtttcgaaccattggcttacagaggtttggaaaccggttctagagaagttgtttctcacgttatcaagcaaggtaagatcgttttcgttttgtcttctgctttgaacccatggaacaaggaaatgggtaaccacttggttaagcacggtgacggtgttaaggacatcgctttcgaagttgaagactgtgactacatcgttcaaaaggctagagaaagaggtgctaagatcgttagagaaccatgggttgaagaagacaagttcggtaaggttaagttcgctgttttgcaaacctacggtgacaccacccacaccttggttgaaaagatgtcttacgctggtagattcttgccaggttacgaagctccagctttcatggacccattgttgccacaattgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagaaagaggtatggaattcttgtctgttccatctacctactacaagcaattgagagaaaagttgaaggttgctaagatcaaggttaaggaatctatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccaacatggaaaccgacggtgttgttccaggtatg

SEQ ID NO: 195 - DNA, 1179 bp, Mesitornis unicolor
atgaccacctactctgacaagggtgctaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaagaagacaacttcggtaaggttaagttcgctgttttgcaaacctacggtgacaccacccacaccttggttgaaaagatgaactacgctggtagattcttgccaggttacaaggctccagctttcatggacccattgttgccacaattgccaaagtgttctttggaagttatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagaggtagaggtatggaattcttgtctgttccatctatgtactacaagcaattgagagaaaagttgaaggttgctaagatcaaggttaaggaatctatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaagacttgagaggtaacttgaccaacatggaaaccgacggtgttgttccaggtatg

SEQ ID NO: 196 - DNA, 1179 bp, Rhinopithecus roxellana
atgaccacctactctgacaagggtgctaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaagaagacaagttcggtaaggttaagttcgctgttttgcaaacctacggtgacaccacccacaccttggttgaaaagatgaactacgctggtagattcttgccaggttacaaggctccagctttcatggacccattgttgccacaattgccaaagtgttctttggaagttatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagaggtagaggtatggaattcttgtctgttccatctacctactacaagcaattgagagaaaagttgaaggttgctaagatcaaggttaaggaatctatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaagacttgagaggtaacttgaccaacatggaaaccgacggtgttgttccaggtatg

SEQ ID NO: 197 - DNA, 1179 bp, Fukomys damarensis
atgaccacctactctaacaagggtgctaagccagaaagaggtagattcttgcacttccactctgttaccttctgggttggtaacgctaagcaagctgctgctttctactgttctaagatgggtttcgaaccattggcttacagaggtttggaaaccggttctagagaagttgtttctcacgctatcaagcaaggtcaaatcgttttcgttttgtcttctgctttgaacccatggaacaaggaaatgggtgaccacttggttaagcacggtgacggtgttaaggacatcgctttcgaagttgaagactgtgactacatcgttcaaaaggcttgggaaagaggtgctaagatcgttagagaaccatgggttgaacaagacaagttcggtaaggttaagttcgctgttttgcaaacctacggtgacaccacccacaccttggttgaaaagatgaactacaccggtagattcttgccaggtttcgaagctccaatgttcaaggacttgttgttgtctagattgccatcttgttctttggaaatcatcgaccacatcgttggtaaccaaccagaccaagaaatggttccagcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtatggaattcttggctgttccatctacctactacaagcaattgagagaaaagttgaagaccgctaagatcagagttaaggaatctatcgacgttttggaagaattgaagatcttggttgactacgacgaaaagggttacttgttgcaaatcttcaccaagccagttcaagacagaccaaccttgttcttggaaatcatccaaagacacaaccaccaaggtttcggtgctggtaacttcaactctttgttcaaggctttcgaagaagaacaagacttgagaggtaacttgaccgacttggaaaccaacggtgctgctccaggtacc

SEQ ID NO: 198 - DNA, 1179 bp, Colobus angolensis palliatus
atgaccacctactctaacaagggtgctaagccagaaagaggtagattcttgcacttccactctgttaccttctgggttggtaacgctaagcaagctgctgctttctactgttctaagatgggtttcgaaccattggcttacagaggtttggaaaccggttctagagaagttgtttctcacgttatcaagcaaggtcaaatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgggttacaccggtagattcttgccaggtttcgaagctccagctttcagagacccattgttgccaaagttgccaaactgtaccttggaaatcatcgaccacatcgttggtaaccaaccagaccaagaaatggttccagcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagaaagaggtaccgaattcttggctgttccatctacctactacaagcaattgagagaaaagttgaagaccgctaagatcagagttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaagctttgagaggtaacttgaccgacttggaaaccaacggtgttgttccaggtatg

SEQ ID NO: 199 - DNA, 1179 bp, Colobus angolensis palliatus
atgaccacctactctaaccaaggtgaaaagccagaaagaggtagattcttgcacttccactctgttaccttctgggttggtaacgctaagcaagctgcttctttctactgttctaagatgggtttcgaaccattggcttacaagggtttggaaaccggttctagagaagttgtttctcacgttatcaagcaaggtaagatcgttttcgttttctcttctgctttgaacccatggaacagagaaatgggtgaccacttggttaagcacggtgacggtgttaaggacatcgctttcgaagttgaagactgtgactacatcgttcaaaaggctagagaaagaggtgctaagatcgttcaagaaccatgggttgaacaagacaagttcggtaaggttaagttcgctgttttgcaaacctacggtgacaccacccacaccttggttgaaaagatgaactactctggttgtttcttgccaggtttcgaaccattggttttcaccgacccattgttgtctaagttgccaaagtgttacttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtttggaattcttggctgttccaccaacctactacaagcaattgagagaaaagttgaagtctgctaagatcagagttaaggaatctatcgacaccttggaagaattgaaggttttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaagacttgagaggtaacttgaccgacatggaagctaacggttctatgccaggtaga

SEQ ID NO: 200 - DNA, 1179 bp, Mandrillus leucophaeus
atgaccacctactctaaccaaggtgaaaagccagaaagaggtagattcttgcacttccactctgttaccttctgggttggtaacgctaagcaagctgcttctttctactgttctaagatgggtttcgaaccattggcttacaagggtttggaaaccggttctagagaagttgtttctcacgttatcaagcaaggtaagatcgttttcgttttctcttctgctttgaacccatggaacagagaaatgggtaaccacttggttaagcacggtgacggtgttaaggacatcgctttcgaagttgaagactgtgactacatcgttcaaaaggctagagaaagaggtgctaagatcgttcaagaaccatgggttgaacaagacaagttcggtaaggttaagttcgctgttttgcaaacctacggtgacaccacccacaccttggttgaaaagatgaactactctggttgtttcttgccaggtttcgaaccattggttttgaccgacccattgttgtctaagttgccaaagtgttacttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtttggaattcttggctgttccaccaacctactacaagcaattgagacaaaagttgaagtctgctaagatcagagttaaggaatctatcgacaccttggaagaattgaaggttttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaagacttgagaggtaacttgaccgacatggaagctaacggttctatgccaggtaag

SEQ ID NO: 201 - DNA, 1179 bp, Macaca nemestrina
atgaccacctactctaacaagggtgaaaagccagaaagaggtagattcttgcacttccactctgttaccttctgggttggtaacgctaagcaagctgcttctttctactgttctaagatgggtttcaagccattggcttacaagggtttggaaaccggttctagagaagttgtttctcacgttatccaacaaggtaagatcgttttcgttttgtcttctgctttgaacccatggaacaccgaaatgggtgaccacttggttaagcacggtgacggtgttaaggacatcgctttcgaagttgaagactgtgactacatcgttcaaaaggctcaagaaagaggtgctaagatcatgagagaaccatgggttgaacaagacaagttcggtaaggttaagttcgctgttttgcaaacctacggtgacaccacccacaccttggttgaaaagatgaactactctggtagattcttgccaggtttcgaagctccagctttcaccgacccattgttgtctaagttgccagactgttgtttggaaatcatcgaccacgttgttggtaaccaaccagaccaagaaatggtttctgcttctgaatggtacgttaagaacttgcaattccacagattctggtctgttgacgacacccaagttcacaccgaatactcttctttgagatctatcgttgttgctaactacgaagaaaccatcaagatgccaatcaacgaaccagctcaaggtaagaagaagtctcaaatccaagaatacgttgactacaacggtggtccaggtgttcaacacatcgctttgaagacccaagacatcatcaccgctatcagacacttgagagaaagaggtttggaattcttgggtgttccatctacctactacaagcaattgagagaaaagttgaagtctgctaagatcagagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttggaaaccaacggtgttggtccaggtatc

SEQ ID NO: 202 - DNA, 1179 bp, Aotus nancymaae
atgaccacctactctgacaagggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaacaagacaagttcggtaaggttaagttggctatgttgcaaacctacggtgacaccacccacaccttggttgaaaagatgaactacaccggtagattcttgccaggtttcgaagctccagcttctgttgacccattgttgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctttgggtaagaagaagtctcaaatccaagaatacgttgactacaacggtggtgctggtgttcaacacatcgctttgaagacccaagacatcatcaccgctatcagacacttgagagaaagaggtttggaattcttggctgttccatctacctactacaagcaattgagagaaaagttgaagtctgctaagatcagagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccaacttggaaaccaacggtatcttgagaggtatg

SEQ ID NO: 203 - DNA, 1179 bp, Propithecus coquereli
atgaccacctactctgacaagggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctagaatcgttagagaaccatggaccgaagaagacaagttcggtaaggttaagttggctgttttgcaaacctacggtgacaccacccacaccttggttgaaaagatgaactacaccggtagattcttgccaggtttcgaagctccagcttctgttgacccattgttgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctttgggtaagaagaagtctcaaatccaagaatacgttgactacaacggtggtgctggtgttcaacacatcgctttgaagacccaagacatcatcaccgctatcagacacttgagagaaagaggtttggaattcttggctgttccatctacctactacaagcaattgagagaaaagttgaagtctgctaagatcagagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttggaaaccaacggtatcttgagaggtatg

SEQ ID NO: 204 - DNA, 1179 bp, Otolemur garnettii
atgaccacctactctgacaagggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacttggttcaaaaggctagagaacaaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccaatctctgttgacccattgttgtctaagttgccaacctgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgaaggctagaggtatggaattcttgggtgttccatcttcttactacaagcaattgagagaaaagttgaagaccgctaagatccaagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaagacttgagaggtaacttgaccaacttggaaaccaactcttctttgagaggtatg

SEQ ID NO: 205 - DNA, 1179 bp, Cavia porcellus
atgaccacctactctgacaagggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacttggttcaaaaggctagagaacaaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccagtttctgttgacccattgttgtctaagttgccaacctgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgaaggctagaggtatggaattcttgggtgttccatcttcttactacagacaattgagagaaaagttgaagaccgctaagatccaagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaagacttgagaggtaacttgaccaacttggaaaccaactcttctttgagaggtatg

SEQ ID NO: 206 - DNA, 1179 bp, Myotis brandtii
atgaccacctactctgacagaggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccagcttctgttgacccattgttgtctaagttgccaacctgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttaccaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagctagaggtatggaattcttgggtgttccatcttcttactacaagcaattgagagaaaagttgaagtctgctaagatccaagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttggaaaccaacggtaccttgagatgtatg

SEQ ID NO: 207 - DNA, 1179 bp, Equus asinus
atgaccacctactctgacaagggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccagcttctgttgacccattgttgtctaagttgccaacctgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagctagaggtatggaattcttgtgtgttccatcttcttactacaagcaattgagagaaaagttgaagtctgctaagatccaagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttggaaaccaacggtaccttgagaggtatg

SEQ ID NO: 208 - DNA, 1383 bp, Marmota marmota marmota
gacgacatcaccttgtctaccgaagctgctgctagatctgaagctccaaagccaggttctttccaaagatggtgtagataccacccatctttgggtagaccaggttctaagggtagagacttgttcggtgttaagtacttctgtccagctttgcactggccattggttccaatctctgaacaagaagcttctccaagatctaccatgaccacctactctgacaagggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccagcttctgttgacccattgttgtctaagttgccaacctgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagctagaggtatggaattcttgtgtgttccatctacctactacaagcaattgagagaaaagttgaagtctgctaagatccaagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttgcaaaccaacggtaccttgagaggtatg

SEQ ID NO: 209 - DNA, 1179 bp, Marmota marmota marmota
atgaccacctactctgacaagggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcatgagagaaccatggatcgaagaagacaagttcggtaaggttaagttggctgttttgcaaacctacggtgacaccacccacaccttggttgaaaagatcaactacaccggtagattcttgccaggtttcgaagctccagcttgtgttgacccattgttgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagacagaggtatggaattcttggctgttccatctacctactacaagcaattgagagaaaagttgaagtctgctaagatccaagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttggaaaccaacggtatgatgccaggtatg

SEQ ID NO: 210 - DNA, 1179 bp, Cebus imitator
atgaccacctactctgacaagggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaagaagacaagttcggtaaggttaagttggctgttttgcaaacctacggtgacaccacccacaccttggttgaaaagatcaactacaccggtagattcttgccaggtttcgaagctccagcttgtgttgacccattgttgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagacagaggtatggaattcttggctgttccatctacctactacaagcaattgagagaaaagttgaagtctgctaagatccaagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttggaaaccaacggtatgatgccaggtatg

SEQ ID NO: 211 - DNA, 1179 bp, Capra hircus
atgaccacctactctgacaagggtaagaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaagaagacaagttcggtaaggttaagttggctgttttgcaaacctacggtgacaccacccacaccttggttgaaaagatgaactacaccggtagattcttgccaggtttcgaagctccagcttgtgttgacccattgttgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagacagaggtatggaattcttggctgttccatctacctactacaagcaattgagagaaaagttgaagtctgctaagatccaagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttggaaaccaacggtaccatgccaggtatg

SEQ ID NO: 212 - DNA, 1179 bp, Panthera pardus
atgaccacctactctgacaagggtagaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaacaagacaagttcggtaaggttaagttggctgttttgcaaacctacggtgacaccacccacaccttggttgaaaagatgaactactctggttggttcttgccaggtttcgaaaccccagcttctgttgacccattgttgtctaagttgccaacctgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaacttcgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagaaagaggtatggaattcttggctgttccaccaacctactacaagcaattgagagaaaagttgaagtctgctaagatcagagttaaggaatctatcgacaccttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttgaagaacaccagaaccttgccaggtacc

SEQ ID NO: 213 - DNA, 1179 bp, Hipposideros armiger
atgaccacctactctgacaagggtagaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaacaagacaagttcggtaaggttaagttggctgttttgcaaacctacggtgacaccacccacaccttggttgaaaagatgaactactctggttggttcttgccaggtttcgaaaccccagcttctgttgacccattgttgtctaagttgccaacctgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaacttcgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagaaagaggtatggaattcttggctgttccaccaacctactacaagcaattgagagaaaagttgaagtctgctaagatcagagttaaggaatctatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttgaagaacaccagaaccttgccaggtatg

SEQ ID NO: 214 - DNA, 1179 bp, Crocodylus porosus
atgaccacctactctgacaagggtaagaagccacaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaacaagacaagttcggtaaggttaagttggctgttttgcaaacctacggtgacaccacccacaccttggttgaaaagatgaactactctggtagattcttgccaggtttcgaaaccccagcttctgttgacccattgttgtctaagttgccatcttgttctttggaaatgatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaacttcgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagaaagaggtatggaattcttggctgttccaccaatgtactacaagcaattgagagaaaagttgaagtctgctaagatcagagttaaggaatctatcgacaccttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttggaaaacaccagaaccttgccaggtatg

SEQ ID NO: 215 - DNA, 1179 bp, Ailuropoda melanoleuca
atgaccacctactctgacaagggtaagaagccacaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaacaagacaagttcggtaaggttaagttggctgttttgcaaacctacggtgacaccacccacaccttggttgaaaagatgaactactctggtagattcttgccaggtttcgaaaccccagcttctgttgacccattgttgtctaagttgccatcttgttctttggaaatgatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaacttcgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagaaagaggtatggaattcttggctgttccaccaacctactacaagcaattgagagaaaagttgaagtctgctaagatcagagttaaggaatctatcgacaccttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacttggaaaacaccagaaccttgccaggtatg

SEQ ID NO: 216 - DNA, 1176 bp, Bos indicus
accacctactctgacaagggtaagaagccacaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatggatcgaacaagacaagttcggtaaggttaagttggctgttttgcaaacctacggtgacaccacccacaccttggttgaaaagatgaactactctggtagattcttgccaggtttcgaaaccccagcttctgttgacccattgttgtctaagttgccatcttgttctttggaaatggttgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaacttcgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagaaagaggtatggaattcttggctgttccaccaacctactacaagcaattgagagaaaagttgaagtctgctaagatcagagttaaggaatctatcgacaccttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgactctgaaaacaccagaaccttgccaggtatg

SEQ ID NO: 217 - DNA, 1179 bp, Castor canadensis
atgaccacctactctaacaagggtgaaaagccagctagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccagctttcgttgacccattgttgtctaagttgccatcttgttctttggaaatcatcgaccacatcgttggtaaccaaccagaccaagaaatggaatctgcttctgactggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtccaggtgttcaacacatcgctttgaagacccaagacatcatcaccgctatcagacacttgagagaaagaggtatggaattcttgggtgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaacaacggtatcgttccaggtatg

SEQ ID NO: 218 - DNA, 1179 bp, Sus scrofa
atgaccacctactctaacaagggtgaaaagccagctagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgctcaaaaggctagagaaagaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccagctttcgttgacccattgttgtctaagttgccatcttgttctttggaaatcatcgaccacatcgttggtaaccaaccagaccaagaaatggaatctgcttctgactggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtccaggtgttcaacacatcgctttgaagacccaagacatcatcaccgctatcagacacttgagagaaagaggtatggaattcttgggtgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaacaacggtatcgttccaggtatg

SEQ ID NO: 219 - DNA, 1179 bp, Microcebus murinus
atgaccacctactctaacaagggtgaaaagccagctagaggtagattcttgcacttccactctgttaccttctgggttggtaacgctaagcaagctgcttctttctactgtaacaagatgggtttcgaaccattggcttacaagggtttggaaaccggttctagagaagttgtttctcacgctatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccagctttcgttgacccattgttgtctaagttgccatcttgttctttggaaatcatcgaccacatcgttggtaaccaaccagaccaagaaatggaatctgcttctgactggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtccaggtgttcaacacatcgctttgaagacccaagacatcatcaccgctatcagacacttgagagaaagaggtatggaattcttgggtgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccagttcaagacagaccaaccttgtctttggaagttatccaaagacacaagcaccaaggtttcggtgctggtaacttcaactctttgttcaaggctttcgaagaagaacaaaacttgagaggtaacttgaccgacttggaaaacaacggtatcgttccaggtatg

SEQ ID NO: 220 - DNA, 1179 bp, Odocoileus virginianus texanus
atgaccacctactctaacaagggtgaaaagccagctagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccaaccttcgttgacccattgttgtctaagttgccatcttgttctttggaaatcatcgaccacatcgttggtaaccaaccagaccaagaaatggaatctgcttctgactggtacttgaagaacttgcaattccacagattctggtctgttgacgacacccaagttcacaccgaatactcttctttgagatctatcgttgttgctaactacgaagaatctatcaagatgccaatcaacgaaccagctttgggtaagaagaagtctcaaatccaagaatacgttgactacaacggtggtccaggtgttcaacacatcgctttgaagacccaagacatcatcaccgctatcagacacttgagagaaagaggtatggaattcttgggtgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaacaacggtatcgttccaggtatg

SEQ ID NO: 221 - DNA, 1179 bp, Phascolarctos cinereus
atgaccacctactctaacaagggtgaaaagccagctagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccagctttcgttgacccattgttgtctaagttgccatcttgttctttggaaatcatcgaccacatcgttggtaaccaaccagaccaagaaatggaatctgcttctgactggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtccaggtgttcaacacatcgctttgaagacccaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgaccgacttcgaaaacaacggtatcgttccaggtatg

SEQ ID NO: 222 - DNA, 1179 bp, Mus pahari
tcttctttgtcttcttctttgttgttgcaaccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttctcttctgctttgaacccatgggacaaggaaatgggtgaccacttggttaagcacggtgacggtgttaaggacatcgctttcgaagttgaagactgtgactacatcgttcaaaaggctaaggaaagaggtgctaagatcgttagagaaccatggatcgaacaagacaagttcggtaaggttaagttggctgttttgcaaacctacggtgacaccacccacaccttggttgaaaagatgaactacaccggtagattcttgccaggtttcgaagctccagttttcatcgacccaatcttgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctttgggtaagaagaagtctcaaatccaagaatacgttgactacaacggtggtccaggtgttcaacacatcgctttgaagacccaagacatcatcaccgctatcagacacttgagagaaagaggtatggaattcttgggtgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtaccgttagaggtatg

SEQ ID NO: 223 - DNA, 1179 bp, Mus caroli
atgaccacctactctgacaagggtgaaaagccagaaagaggtagattcttgcacttccactctgttaccttctgggttggtaacgctaagcaagctgcttctttctactgttctaagatgggtttcgaaccattggcttacaagggtttggaaaccggttctagagaagttgtttctcacgctatcaagcaaggtaagatcgttttcgttttctcttctgctttgaacccatggaacaaggaaatcggtgaccacttggctaagcacggtgacggtgttaaggacatcgctttcgaagttgaagactgtgactacatcgttcaaaaggctaaggaaagaggtgctaaggttgttagagaaccatggatcgaacaagacaagttcggtaaggttaagttggctgttttgcaaacctacggtgacaccacccacaccttggttgaaaagatgaactacaccggtttgttcttgccaggtttcgaagctccagttttcttggacccattgttgtctaagttgccatcttgttctttggaaatcatcgaccacatcgttggtaaccaaccagaccaagaaatggtttctgctgctgaatggtacttgaagaacttgcaattccacagattctggtctgttgacgacacccaagttcacaccgaatactcttctttgagatctatcgttgttgctaactacgaagaaaacatcaagatgccaatcaacgaaccagctccaggtaagaagaagtctcaaatccaagaatacgttgactacaacggtggtccaggtgttcaacacatcgctttgaagacccaagacatcatcaccgctatcagacacttgagagaaagaggtatggaattcttgggtgttccatctacctactacaagcaattgagagaaagattgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaaaacttgagaggtaacttgaccgacttggaaaccaacggtgttgttccaggtatg

SEQ ID NO: 224 - DNA, 1161 bp, Mesocricetus auratus
atgaccacctactctgacaagggtgaaaagccagaaagaggtagattcttgcacttccactctgttaccttctgggttggtaacgctaagcaagctgcttcttactactgttctaagatgggtttcgaaccattggcttacaagggtttggaaaccagatctagagacgttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcacacctacggtgacaccacccacaccttggttgaaaagatgaactacaccggtagattcttgccaggtttcgaagctccagcttctaccgacccattgttgtctaagttgccaaactgttgtttggaaatcatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaacacccaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacatggaaacctct

SEQ ID NO: 225 - DNA, 1161 bp, Meriones unguiculatus
atgaccacctactctgacaagggtgaaaagccagaaagaggtagattcttgcacttccactctgttaccttctgggttggtaacgctaagcaagctgcttcttactactgttctaagatgggtttcgaaccattggcttacaagggtttggaaaccagatctagagacgttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtagattcttgccaggtttcgaagctccagcttctaccgacccattgttgtctaagttgccaaactgttgtttggaaatcatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaacacccaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacatggaaacctct

SEQ ID NO: 226 - DNA, 1170 bp, Enhydra lutris kenyoni
atgaccacctactctaacaagggtgaaaagccagaaagaggtagattcttgcacttccactctgttaccttctgggttggtaacgctaagcaagctgcttcttactactgttctaagatgggtttcgaaccattggcttacaagggtttggaaaccagatctagagaagttgtttctcacgttatcaagcaaggtaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtagattcttgccaggtttcgaagctccagcttctaccgacccattgttgtctaagttgccaaactgtggtttggaaatcatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacatggaaacctctggtgttgtt

SEQ ID NO: 227 - DNA, 1176 bp, Delphinapterus leucas
accacctactctaacaagggtgaaaagccagaaagaggtagattcttgcacttccactctgttaccttctgggttggtaacgctaagcaagctgcttcttactactgttctaagatgggtttcgaaccattggcttacaagggtttggaaaccggttctagagaaatggtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccagctttcgttgacccattgttgtctaagttgccaaactgttctttggaaagaatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccacagatacaaccaccaaggtttcggtgctggtaacttcaactctttgttcaaggctttcgaagaagaacaagacttgagaggtaacttgaccgacatggaaaccaacggtaccgttgctggtacc

SEQ ID NO: 228 - DNA, 1179 bp, Loxodonta africana
atgaccacctactctaacaagggtgaaaagccagaaagaggtagattcttgcacttccactctgttaccttctgggttggtaacgctaagcaagctgcttcttactactgttctaagatgggtttcgaaccattggcttacaagggtttggaaaccggttctagagaaatggtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccagctttcgttgacccattgttgtctaagttgccaaactgttctttggaaagaatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccacagatacaaccaccaaggtttcggtgctggtaacttcaactctttgttcaaggctttcgaagaagaacaagacttgagaggtaacttgaccgacatggaaaccaacggtaccgctgctggtacc

SEQ ID NO: 229 - DNA, 1179 bp, Octodon degus
atgaccacctactctaacaagggtgaaaagccagaaagaggtagattcttgcacttccactctgttaccttctgggttggtaacgctaagcaagctgcttcttactactgttctaagatgggtttcgaaccattggcttacaagggtttggaaaccggttctagagaaatggtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccagctttcgttgacccattgttgtctaagttgccaaactgttctttggaaagaatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccacagatacaaccaccaaggtttcggtgctggtaacttcaactctttgttcaaggctttcgaagaagaacaagacttgagaggtaacttgaccgacatggaaaccaacggtaccgttgctggtatg

SEQ ID NO: 230 - DNA, 1179 bp, Chrysemys picta bellii
atgaccacctactctaacaagggtgaaaagccagaaagaggtagattcttgcacttccactctgttaccttctgggttggtaacgctaagcaagctgcttcttactactgttctaagatgggtttcgaatctttggcttacaagggtttggaaaccggttctagagaaatggtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgctcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagttccagctttcgttgacccattgttgtctaagttgccaaactgttctttggaaagaatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagatacaaccaccaaggtttcggtgctggtaacttcaactctttgttcaaggctttcgaagaagaacaagacttgagaggtaacttgaccgacatggaaaccaacggtaccgttgctggtatg

SEQ ID NO: 231 - DNA, 1179 bp, Pongo abelii
atgaccacctactctaacaagggtgaaaagccagaaagaggtagattcttgcacttccactctgttaccttctgggttggtaacgctaagcaagctgcttcttactactgttctaagatgggtttcgaatctttggcttacaagggtttggaaaccggttctagagaagttgtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccagctttcgttgacccattgttgtctaagttgccaaactgttctttggaaagaatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcaccaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagatacaaccaccaaggtttcggtgctggtaacttcaactctttgttcaaggctttcgaagaagaacaagacttgagaggtaacttgaccgacatggaaaccaacggtaccgttgctggtatg

SEQ ID NO: 232 - DNA, 1179 bp, Terrapene carolina triunguis
atgaccacctactctaacaagggtgaaaagccagaaagaggtagattcttgcacttccactctgttaccttctgggttggtaacgctaagcaagctgcttcttactactgttctaagatgggtttcgaatctttggcttacaagggtttggaaaccggttctagagaaaccgtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccagctttcgttgacccattgttgccaaagttgccaaactgttctttggaaagaatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagatacaaccaccaaggtttcggtgctggtaacttcaactctttgttcaaggctttcgaagaagaacaagacttgagaggtaacttgaccgacatggaaaccaacggtaccgttccatctatg

SEQ ID NO: 233 - DNA, 1176 bp, Neophocaena asiaeorientalis asiaeorientalis
tctttggctccatctttgttgttgcaaccagaaagaggtagattcttgcacttccactctgttaccttctgggttggtaacgctaagcaagctgcttcttactactgttctaagatgggtttcgaaccattggcttacaagggtttggaaaccggttctagagaaaccgtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccagctttcgttgacccattgttgtctaagttgccaaactgttctttggaaagaatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagatacaaccaccaaggtttcggtgctggtaacttcaactctttgttcaaggctttcgaagaagaacaagacttgagaggtaacttgaccgacatggaaaccaacggtaccgttccaggtatg

SEQ ID NO: 234 - DNA, 1179 bp, Theropithecus gelada
  misc_feature (1042)..(1047): n is a, c, g, or t
atgaccacctactctaacaagggtgaaaagccagaaaagggtagattcttgcacttccactctgttaccttctgggttggtaacgctaagcaagctgcttcttactactgttctaagatgggtttcgaaccattggcttacaagggtttggaaaccggttctagagaaatggtttctcacgttatcaagcaaggtaagatcgctttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccaggtttcgttgacccattgttgtctaagttgccaaactgttctttggaaatcatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacgttgctttgaagaccgaagacatcatcaccgctatcagacacttgagagaaagaggtatggaattcttggctgttccatctacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcnnnnnngttatccaaagatacaaccaccaaggtttcggtgctggtaacttcaactctttgttcaaggctttcgaagaagaacaagacttgagaggtaacttgaccgacatggaaaccaacggtaccacctgtggtatg

SEQ ID NO: 235 - DNA, 1179 bp, Callorhinus ursinus
atgaccacctactctaacaagggtcaaaagccagaaagaggtcaattcttgcacttccactctgttaccttctgggttggtaacgctaagcaagctgcttcttactactgttctaagatgggtttcgaaccattggcttacaagggtttggaaaccggttctagagaaatggtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccagctttcgttgacccattgttgtctaagttgccaaactgttctttgaagatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatccaccacttgagagaaagaggtatggaattcttggctgttccatctacctactacaagcaattgagagaaaagttgaagaccgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagatacaaccaccaaggtttcggtgctggtaacttcaactctttgttcaaggctttcgaagaagaacaagacttgagaggtaacttgaccgacatggaaaccaacggtttggttccaggtatg

SEQ ID NO: 236 - DNA, 1179 bp, Vulpes vulpes
atgaccacctactctaacaagggtcaaaagccagaaagaggtcaattcttgcacttccactctgttaccttctgggttggtaacgctaagcaagctgcttcttactactgttctaagatgggtttcgaaccattggcttacaagggtttggaaaccggttctagagaaatggtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccagctttcgttgacccattgttgtctaagttgccaaactgttctttgaagatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatccaccacttgagagaaagaggtatggaattcttggctgttccatctacctactacaagcaattgagagaaaagttgaagaccgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagatacaaccaccaaggtttcggtgctggtaacttcaactctttgttcaaggctttcgaagaagaacaagacttgagaggtaacttgaccgacatggaaaccaacggtttggctccaggtatg

SEQ ID NO: 237 - DNA, 1179 bp, Urocitellus parryii
atgaccacctactctaacaagggtcaaaagccagaaagaggtcaattcttgcacttccactctgttaccttctgggttggtaacgctaagcaagctgcttcttactactgttctaagatgggtttcgaaccattggcttacaagggtttggaaaccggttctagagaaatggtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttggttcttgccaggtttcgaagctccagctttcgttgacccattgttgtctaagttgccaaactgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatccaccacttgagagaaagaggtatggaattcttggctgttccatctacctactacaagcaattgagagaaaagttgaagaccgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagatacaaccaccaaggtttcggtgctggtaacttcaactctttgttcaaggctttcgaagaagaacaagacttgagaggtaacttgaccgacatggaaaccaacggtttggctccaggtatg

SEQ ID NO: 238 - DNA, 1179 bp, Ursus arctos horribilis
atgaccacctactctaacaagggtgaaaagccagaaagaggtcaattcttgcacttccactctgttaccttctgggttggtaacgctaagcaagctgcttcttactactgttctaagatgggtttcgaaccattggcttacaagggtttggaaaccggttctagagaaatggtttctcacgttatcaagcaaggtaagatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtagagttaagttcgctgttttgcaaacctacggtgacaccacccacaccttggttgaaaagatgaactacaccggttggttcttgccaggtttcgaagctccagctttcgttgacccattgttgtctaagttgccaaactgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtatggaattcttggctgttccattcacctactacaagcaattgagagaaaagttgaagtctgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagatacaaccaccaaggtttcggtgctggtaacttcaactctttgttcaaggctttcgaagaagaacaagacttgagaggtaacttgaccgacatggaaaccaacggtgttggttctggtatg

SEQ ID NO: 239 - DNA, 1179 bp, Acinonyx jubatus
atgaccacctactctaacaagggtgaaaagccagaaaagggtagattcttgcacttccactctgttaccttctgggttggtaacgctaagcaagctgcttctttctactgtaacaagttgggtttcgaaccattggcttacaagggtttggaaaccggttctagagaagttgtttcttacgttatcaagcaaggtaagatcatcttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgtcttacgctggtagattcttgccaggtttcgaagctccagctttcagagacccattgttgtctaagttgccaaactgttctttggaaatcatcgaccacgttgttggtaaccaaccagaccacgaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccacgacatcatcaccgctatcagacacttgagagaaagaggtatggaattcttggctgttccatcttcttactacagacaattgcaagaaaagttgaagtctgctaagatcagagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaagacttgagaggtaacttgaccgacatgcaaaccaacatcttggctccaggtaag

SEQ ID NO: 240 - DNA, 1179 bp, Homo sapiens
atgaccacctactctaacaagggtgaaaagccagaaaagggtagattcttgcacttccactctgttaccttctgggttggtaacgctaagcaagctgcttctttctactgtaacaagttgggtttcgaaccattggcttacaagggtttggaaaccggttctagagaagttgtttctcacgttatcaagcaaggtaagatcatcttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgtcttacgctggtagattcttgccaggtttcgaagctccagctttcagagacccattgttgtctaagttgccaaactgttctttggaaatcatcgaccacgttgttggtaaccaaccagaccacgaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccacgacatcatcaccgctatcagacacttgagagaaagaggtatggaattcttggctgttccatcttcttactacagacaattgcaagaaaagttgaagtctgctaagatcagagttaaggaatctatcgacgttttggaagaattgaagatcttggttgactacgacgaaaagggttacttgttgcaaatcttcaccaagccaacccaagacagaccaaccttgttcttggaagttatccaaagacacaaccaccaaggtttcggtgctggtaacttcaacgctttgttcaaggctttcgaagaagaacaagacttgagaggtaacttgaccgacatgcaaaccaacgacttggttccaggtaag

SEQ ID NO: 241 - DNA, 1179 bp, Gulo gulo
atgaccacctactctgacaagggtgaaaagccagaaagaggtagattcttgcacttccactctgttaccttctgggttggtaacgctaagcaagctgcttcttactactgttctaagttgggtttcgaaccattggcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttgggtaaggttaagttcgctgttttgcaaacctacggtgacaccacccacaccttggttgaaaagatgaactacaccggtagattcttgccaggtttcgaagctccaccattcatggacccacaattgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctgttgttgttgctaactacgaagaatctatcaagatgccaatcaacgaaccagctccaggtaagaagaagtctcaaatccaagaatacgttgactacaacggtggtgctggtgttcaacacatcgctttgaagaccaaggacatcatcaccgctatcagacacttgagagaaagaggtgttgaattcttggctgttccatctacctactacaagcaattgagagaaaagttgaagatggctaagatcagagttaaggaaaacatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacatggaaccaaacggtgttgtttctggtatg

SEQ ID NO: 242 - DNA, 1179 bp, Bos indicus x Bos taurus
atgaccacctactctgacaagggtgaaaagccagaaagaggtagattcttgcacttccactctgttaccttctgggttggtaacgctaagcaagctgcttcttactactgttctaagttgggtttcgaaccattggcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttgggtaaggttaagttcgctgttttgcaaacctacggtgacaccacccacaccttggttgaaaagatgaactacaccggtagattcttgccaggtttcgaagctccaccattcatggacccacaattgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctgttgttgttgctaactacgaagaatctatcaagatgccaatcaacgaaccagctccaggtaagaagaagtctcaaatccaagaatacgttgactacaacggtggtgctggtgttcaacacatcgctttgaagaccaaggacatcatcaccgctatcagacacttgagagaaagaggtgttgaattcttggctgttccatctacctactacaagcaattgagagaaaagttgaagatggctaagatcagagttaaggaaaacatcgacatcttggaagaattgaagatcttggttgactacgacgaaaagggttacttgttgcaaatcttcaccaagccaatgcaagacagaaccaccatcttcttggaagttatccaaagacacaaccaccaaggtttcggtgctggtaacttcaactctttgttcaaggctttcgaagaagaacaagacttgagaggtaacttgaccgacatggaaccaaacggtgttgtttctggtatg

SEQ ID NO: 243 - DNA, 1179 bp, Tupaia chinensis
atgaccacctactctgacaagggtgaaaagccagaaagaggtagattcttgcacttccactctgttaccttctgggttggtaacgctaagcaagctgcttcttactactgttctaagttgggtttcgaaccattggcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttgggtaaggttaagttcgctgttttgcaaacctacggtgacaccacccacaccttggttgaaaagatgaactacaccggtagattcttgccaggtttcgaagctccaccattcatggacccacaattgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctgttgttgttgctaactacgaagaatctatcaagatgccaatcaacgaaccagctccaggtaagaagaagtctcaaatccaagaatacgttgactacaacggtggtgctggtgttcaacacatcgctttgaagaccaaggacatcatcaccgctatcagacacttgagagaaagaggtgttgaattcttggctgttccatctacctactacaagcaattgagagaaaagttgaagtctgctaagatcagagttaaggaaaacatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacatggaaccaaacggtgttgtttctggtatg

SEQ ID NO: 244 - DNA, 1179 bp, Vombatus ursinus
  misc_feature (463)..(465): n is a, c, g, or t
  misc_feature (1165)..(1167): n is a, c, g, or t
atgaccacctactctgacaagggtgaaaagccagaaagaggtagattcttgcacttccactctgttaccttctgggttggtaacgctaagcaagctgcttcttactactgttctaagttgggtttcgaaccattggcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttgggtaaggttaagttcgctgttttgcaaacctacggtgacaccacccacaccttggttgaaaagatgaactacaccggtnnnttcttgccaggtttcgaagctccaccattcatggacccacaattgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctgttgttgttgctaactacgaagaatctatcaagatgccaatcaacgaaccagctccaggtaagaagaagtctcaaatccaagaatacgttgactacaacggtggtgctggtgttcaacacatcgctttgaagaccaaggacatcatcaccgctatcagacacttgagagaaagaggtgttgaattcttggctgttccatctacctactacaagcaattgagagaaaagttgaagatggctaagatcagagttaaggaaaacatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacatggaaccaaacggtnnngtttctggtatg

SEQ ID NO: 245 - DNA, 1179 bp, Eptesicus fuscus
atgaccacctactctgacaagggtgaaaagccagaaagaggtagattcttgcacttccactctgttaccttctgggttggtaacgctaagcaagctgcttcttactactgttctaagttgggtttcgaaccattggcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttgggtaaggttaagttcgctgttttgcaaacctacggtgacaccacccacaccttggttgaaaagatgaactacaccggtagattcttgccaggtttcgaagctccaccattcatggacccacaattgtctaagttgccatcttgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctgttgttgttgctaactacgaagaatctatcaagatgccaatcaacgaaccagctccaggtaagaagaagtctcaaatccaagaatacgttgactacaacggtggtgctggtgttcaacacatcgctttgaagaccaaggacatcatcaccgctatcagacacttgagagaaagaggtgttgaattcttggctgttccatctacctactacaagcaattgagagaaaagttgaagatggctaagatcagagttaaggaaaacatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacatggaaccaaacggtggtgtttctggtatg

SEQ ID NO: 246 - DNA, 1179 bp, Sousa chinensis
atgaccacctactctgacaagggtgaaaagccagaaagaggtagattcttgcacttccactctgttaccttctgggttggtaacgctaagcaagctgcttcttactactgttctaagttgggtttcgaaccattggcttacaagggtttggaaaccggttctagagaagttgtttctcacgttgttaagcaaggtcaaatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttgggtaaggttaagttcgctgttttgcaaacctacggtgacaccacccacaccttggttgaaaagatgaactacaccggtagattcttgccaggtttcgaagctccagctttcatggacccacaattgtctaagttgccaaactgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccaaggacatcatcaccgctatcagacacttgagagaaagaggtgttgaattcttggctgttccatctacctactacaagcaattgagagaaaagttggaatctgctaagatcagagttaaggaaaacatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacatggaaccaaacggtgttgtttcttctatg

SEQ ID NO: 247 - DNA, 1179 bp, Platysternon megacephalum
atgaccacctactctgacaagggtgaaaagccagaaagaggtagattcttgcacttccactctgttaccttctgggttggtaacgctaagcaagctgcttcttactactgttctaagttgggtttcgaaccattggcttacaagggtttggaaaccggttctagagaagttgtttctcacgttgttaagcaaggtcaaatcgttttcatcttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttgggtaaggttaagttcgctgttttgcaaacctacggtgacaccacccacaccttggttgaaaagatgaactacaccggtagattcttgccaggtttcgaagctccagctttcatggacccacaattgtctaagttgccaaactgtggtttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccaaggacatcatcaccgctatcagacacttgagagaaagaggtgttgaattcttggctgttccatctacctactacaagcaattgagagaaaagttgaagtctgctaagatcagagttaaggaaaacatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacatggaaccaaacggtgttgtttcttctatg

SEQ ID NO: 248 - DNA, 1179 bp, Grammomys surdaster
atgaccacctactctgacaagggtgaaaagccagaaagaggtagattcttgcacttccactctgttaccttctgggttggtaacgctaagcaagctgcttcttactactgttctaagttgggtttcgaaccattggcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacgttgctttcgaagttgaagactgtgactacatcgttcaaaaggctagagaaagaggtgctaagatcgttagagaaccatggttggaacaagacaagttgggtaaggttaagttcgctgttttgcaaacctacggtgacaccacccacaccttggttgaaaagatgaactacaccggtagattcttgccaggtttcgaagctccagctttcatggacccacaattgtctaagttgccaaactgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtccaggtgttcaacacatcgctttgaagaccaaggacatcatcaccgctatcagacacttgagagaaagaggtgttgaattcttggctgttccatctacctactacaagcaattgagagaaaagttgaagtctgctaagatcagagttaaggaaaacatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacaccgaaccaaacggtgttgtttcttctatg

SEQ ID NO: 249 - DNA, 1179 bp, Monodon monoceros
atgaccacctactctgacaagggtgaaaagccagaatctggtagattcttgcacttccactctgttaccttctgggttggtaacgctaagcaagctgcttcttactactgttctaagttgggtttcgaaccattggcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtagattcttgccaggtttcgaagctccagctttcatggacccacaattgtctaagttgccaaactgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtccaggtgttcaacacatcgctttgaagaccaaggacatcatcaccgctatcagacacttgagagaaagaggtgttgaattcttggctgttccatctacctactacaagcaattgagagaaaagttgaagtctgctaagatcagagttaaggaaaacatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaagacttgagaggtaacttgaccgacatggaaccaaacggtgttgttccaggtatg

SEQ ID NO: 250 - DNA, 1179 bp, Monodon monoceros
atgacctcttactctgacaagggtgaaaagccagaaagaggtagattcttgcacttccactctgttaccttctgggttggtaacgctaagcaagctgcttcttactactgttctaagatcggtttcgaaccattggcttacaagggtttggaaaccggttctagagaagttgtttctcacgttgttaagcaagacaagatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctatcatcgttagagaaccatggatcgaacaagacaagttcggtaaggttaagttcgctgttttgcaaaccttcggtgacaccacccacaccttggttgaaaagatgaactacaccggttgtttcttgccaggtttcgaagctccaaccttcaccgacccattgttgtctaagttgccaaagtgtggtttggaaatcatcgaccacatcgttggtaaccaaccagaccaagaaatggaatctgcttctcaatggtacatgagaaacttgcaattccacagattctggtctgttgacgacacccaaatccacaccgaatactctgctttgagatctgttgttatggctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagatctttgagagaaagaggtgttgaattcttggctgttccattcacctactacaagcaattgcaagaaaagttgaagtctgctaagatcagagttaaggaatctatcgacgttttggaagaattgaagatcttggttgactacgacgaaaagggttacttgttgcaaatcttcaccaagccaatgcaagacagaccaaccgttttcttggaagttatccaaagaaacaaccaccaaggtttcggtgctggtaacttcaactctttgttcaaggctttcgaagaagaacaagaattgagaggtaacttgaccgacaccgacccaaacggtgttgctttcagattg

SEQ ID NO: 251 - DNA, 1179 bp, Suricata suricatta
atgacctcttactctgacaagggtaagaagccagaaagaggtagattcttgcacttccactctgttaccttctgggttggtaacgctaagcaagctgcttctttctactgttctaagatgggtttcgaaccattggcttacagaggtttggaaaccggttctagagaagttgcttctcacgttatcaagcaaggtcaaatcgttttcgttttctcttctgctttgaacccatggaacaaggaaatgggtgaccacttggttagacacggtgacggtgttaaggacgttgctttcgaagttcaagactgtgactctatcgttcaaaaggctcaagaaagaggtgctaagatcatcagagaaccatgggttgaacaagacaagttcggtaaggttaagttcgctgttttgcaaaccttcggtgacaccacccacaccttggttgaaaagatgaactacagaggtccattcttgccaggtttcatggctagagctccaagagactctttgttgtctaagttgccacaatgtaacttggaagttatcgaccacgttgttggtaaccaaccagaccaagaaatgttgtctgcttctgaatggtacttgaacaacttgcaattccacagattctggtctgttgacgacaaggaattgcacaccgaatactcttctttgagatctatcgttgttaccaactacgaagaatctatcaagatcccaatcaacgaaccagctccaggtagaaagaagtctcaaatccaagaatacgttgactactacggtggtgctggtgttcaacacatcgctttgaagacccaagacatcatcaccaccatcagatctttgaaggaaagaggtatggaattcttgaacaccccaccaacctactacaagcaattgagagaaaagttgaagtctgctaagatcagagttcaagaaaacatggacaccttggaagaattgaagatcttggttgactacgacgaaaacggttacttgttgcaaatcttctctaagccaatgcaagacagaccaaccttgttcttggaagttatccaaagacacaaccaccaaggtttcggtgctggtaacttcaactctttgttcaaggctttggaagaagaacaaaacttgagaggtaacttgaccgacttggaaaccaacggtgttgttccaggtatg

SEQ ID NO: 252 - DNA, 1179 bp, Lynx canadensis
atgacctcttactctaacaagggtgaaaagccagaaagaggtagattcttgcacttccactctgttaccttctgggttggtaacgctaagcaagctgcttctttctactgttctaagatgggtttcaagccaatcgcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagacaaagaggtgctaagatcatcagagaaccatgggttgaacaagacaagttcggtaaggttaagttcgctgttttgcaaacctacggtgacaccacccacaccttggttgaaaagatgaactacgctggtttcttcttgccaggtttcgaaccaaccaccaacagagaccaagctttgtctaagttgccacaatctaacttggaagttatcgaccacatcgttggtaaccaaccagaccaagaaatgttgtctgcttctgactggtacttgaacaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtatggaattcttggacgttccatctacctactacaagcaattgagagaaaagttgaagtctgctaagatcagagttaaggaaaacttggacgctttggaagaattgaagatcttggttgactacgacgaaaacggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaaaacatgagaggtaacttgaccgacttggaaccaaacggtgttatcagaggtatg

SEQ ID NO: 253 - DNA, 1179 bp, Marmota monax
atgacctcttactctaacaagggtgaaaagccagaaagaggtagattcttgcacttccactctgttaccttctgggttggtaacgctaagcaagctgcttctttctactgttctaagatgggtttcaagccaatcgcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagacaaagaggtgctaagatcatcagagaaccatgggttgaacaagacaagttcggtaaggttaagttcgctgttttgcaaacctacggtgacaccacccacaccttggttgaaaagatgaactacaccggtttcttcttgccaggtttcgaaccaaccaccaacagagacccagctttgtctaagttgccacaatctaacttggaagttatcgaccacatcgttggtaaccaaccagaccaagaaatgttgtctgcttctgactggtacttgaacaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtatggaattcttggacgttccatctacctactacaagcaattgagagaaaagttgaagtctgctaagatcagagttaaggaaaacttggacgctttggaagaattgaagatcttggttgactacgacgaaaacggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaaaacatgagaggtaacttgaccgacttggaaccaaacggtgttatcagaggtatg

SEQ ID NO: 254 - DNA, 1179 bp, Nomascus leucogenys
atgacctcttactctaacaagggtgaaaagccagaaagaggtagattcttgcacttccactctgttaccttctgggttggtaacgctaagcaagctgcttctttctactgttctaagatgggtttcaagccaatcgcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagacaaagaggtgctaagatcatcagagaaccatgggttgaacaagacaagttcggtaaggttaagttcgctgttttgcaaacctacggtgacaccacccacaccttggttgaaaagatgaactacaccggtttcttcttgccaggtttcgaaccaaccaccaacagagacccagttttgtctaagttgccacaatctaacttggaagttatcgaccacatcgttggtaaccaaccagaccaagaaatgttgtctgcttctgctagatacttgaacaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtatggaattcttggacgttccatctacctactacaagcaattgagagaaaagttgaagtctgctaagatcagagttaaggaatctttggacgctttggaagaattgaagatcttggttgactacgacgaaaacggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaaaacttgagaggtaacttgaccgacttggaaccaaacggtgttatcagaggtatg

SEQ ID NO: 255 - DNA, 1179 bp, Rhinopithecus roxellana
atgacctcttacaccaacagaggtgaaaagccagaaagaggtagattcttgcacttccactctgttaccttctgggttggtaacgctaagcaagctgcttctttctactgttctaagatgggtttcaagccattggcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagacaaagaggtgctaagatcatcagagaaccatgggttgaacaagacaagttcggtaaggttaagttcgctgttttgcaaacctacggtgacaccacccacaccttggttgaaaagatgaactacaccggtttcttcttgccaggtttcgaaccaaccaccaacagagacccagctttgtctaagttgccacaatctaacttggaagttatcgaccacatcgttggtaaccaaccagaccaagaaatgttgtctgcttctgactggtacttgaacaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtatggaattcttggacgttccatctacctactacaagcaattgagagaaaagttgaagtctgctaagatcagagttaaggaatctttggacgctttggaagaattgagaatcttggttgactacgacgaaaacggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaaaacttgagaggtaacttgaccgacatggaaaccaacggtgttgttagaggtatg

SEQ ID NO: 256 - DNA, 1179 bp, Muntiacus muntjak
atgacctcttacaccaacaagggtgaaaagccagaaagaggtagattcttgcacttccactctgttaccttctgggttggtaacgctaagcaagctgcttcttactactgttctaagatgggtttcaagccattggcttacagaggtttggaaaccggttctagagaagttgtttctcacgttgttaagcaaggtcaaatcgttttcatcttctcttctgctttgaacccatggaacaaggaaatgggtgaccacttggttaagcacggtgacggtgttaaggacatcgctttcgaagttgaagactgtgactacatcgttcaaaaggctagacaaagaggtgctaagatcatcagagaaccatgggttgaacaagacaagttcggtaaggttaagttcgctgttttgcaaacctacggtgacaccacccacaccttggttgaaaagatggactacaccggtttgttcttgccaggtttcaacccaaccacccacaccgactctgttttgtctaagttgccacaatctaacttggaagttatcgaccacatcgttggtaaccaaccagaccaagaaatgttgtctgcttctgactggtacttgaacaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtatggaattcttggacgttccagctacctactacagacaattgagagaaaagttgaagtctgctaagatcagagttaaggaatctttggacaccttggaagaattgaagatcttggttgactacgacgaaaacggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaaaacttgagaggtaacttgaccgacatggaaaccaacggtgttgttagaggtatg

SEQ ID NO: 257 - DNA, 1179 bp, Mastomys coucha
atgacctcttactctaacaagggtgaaaagccagaaagaggtagattcttgcacttccactctgttaccttctgggttggtaacgctaagcaagctgcttctttctactgttctaagatgggtttcaagccattggcttacagaggtttggaaaccggttctagagacgttgtttctcacgttgttaagcaaggtcaaatcgttttcgttttctcttctgctttgaacccatggaacaaggacatgggtgaccacttggttaagcacggtgacggtgttaaggacatcgctttcgaagttgaagactgtgactacatcgttcaaaaggctagagaaagaggtgctaagatcatcagagaaccatgggttgaacaagacaagttcggtaaggttaagttcgctgttttgcaaacctacggtgacaccacccacaccttggttgaaaagatgaagtacaccggtttcttcttgccaggtttcgaaccagttgctaagatggacccagctttgtctaagttgccacaatgtaacttggaagttatcgaccacatcgttggtaaccaaccagaccaagaaatggaatctgcttctgactggtacttgaacaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgaatacaacggtggtgctggtgttcaacacatcgctttgaagacccaagacatcatcaccgctatcagacacttgagagaaagaggtatggaattcttggacgttccatctacctactacaagcaattgagagaaaagttgaagtctgctaagatcagagttaaggaaaacatcgaaatcttggaagaattgagaatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaaaacttgagaggtaacttgaccgacatggaaccaaacggtgttttgagaggtatg

SEQ ID NO: 258 - DNA, 1179 bp, Camelus dromedarius
atgacctcttactctaacaagggtccaaagccagaaagaggtagattcgttcacttccactctgttaccttctgggttggtaacgctaagcaagctgcttctttctactgtaccagaatgggtttcgaaccattggcttacagaggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacgttgctttcgaagttgaagactgtgactacatcgttcaaaaggctcaagaaagaggtgctaagatcatcagagaaccatgggttgaacaagacaagttcggtaaggttaagttcgctgttttgcaaacctacggtgacaccacccacaccttggttgaaaagatgtcttacaccggttgtttcttgccaggtttcaagggtttggactctaaggacgctttgttgtctaagttgccacactgttgtttggaagttatcgaccacatcgttggtaaccaaccagaccaagaaatgcaatctgcttctgaatggtacttgaagaacttgcaattccacagattctggtctgttgacgacacccaagttcacaccgaatactcttctttgagatctatcgttgttaccaactacgaagaatctatcaagatgccaatcaacgaaccagctccaggtaagaagaagtctcaaatccaagaatacgttgacttcaacggtggtgctggtgttcaacacatcgctttgaagacccaagacatcatctctgctatcagacacttgagagaaagaggtatggaattcttgcacgttccatctacctactacaagcaattgagagaaaagttgaagtctgctaagatcagagttaaggaaaacatggacgttttggaagaattgaacatcttggttgactacgacgacaagggttacttgttgcaaatcttcaccaagccaatgcaagacagaccaaccttgttcttggaaatcatccaaagacacaaccaccaaggtttcggtgctggtaacttcaacgctttgttcgaagctatcgaagaagaacaagctttgagaggtaacttgaccgacttggaaaccaacggtgttgttcaaggtaag

SEQ ID NO: 259 - DNA, 1179 bp, Papio anubis
atgacctcttactctgacaagggtcaaaagccagaaagaggtagattcttgcacttccactctgttaccttctgggttggtaacgctaagcaagctgcttctttctactgttctaaggttggtttcgaaccattggcttacaagggtttggaaaccggttctagagaagttgtttctcacgttgttaagcaaggtcaaatcgttttcgttttctcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcatcagagaaccatgggttgaacaagacaagttcggtaaggttaagttggctgttttgcaaacctacggtgacaccacccacaccttggttgaaaagatgaactacaccggttgtttcttgccaggtttcgaagctgttgactgtaaggacccattgttgtctaagttgccacaatgtggtttggaagttgttgaccacatcgttggtaaccaaccagaccaagaaatgcaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccggtgacatcatctctgctatcagacacttgagagaaagaggtatggaattcttgcacgttccatctacctactacaagcaattgagagaaaagttgaagtctgctaagatcagagttaaggaaaacttggacgttttggaagaattgagaatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaagctttgagaggtaacttgaccgacatggaaatcaacggtatcgctagaggtatg

SEQ ID NO: 260 - DNA, 1179 bp, Sarcophilus harrisii
atgacctcttactctaacaagggtgaaaagccagttagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtgaaatcgttttcgttttctcttctgctttgaacccatggcacaaggaaatgggtgaccacttggttaagcacggtgacggtgttaaggacatcgctttcgaagttgaagactgtgactacatcgttcaaaaggctagagaaagaggtgctaagatcatcagagaaccatgggttgaacaagacaagttcggtaaggttaagttcgctgttttgcaaacctacggtgacaccacccacaccttggttgaaaagatgaactacaccggtagattcttgccaggtttcgaagctccagttttcaaggacccacaattgtctaagttgccacactgtaagttggaagttatcgaccacatcgttggtaaccaaccagaccaagaaatggtttctgcttctgactggtacttgaacaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccacgacatcatcaccgctatcagacacttgagagaaagaggtatcgaattcttggctgttccatctacctactacaagcaattgagagaaaagttgaagtctgctaagatcagagttaaggaaaacatcgacatcttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaaaacttgagaggtaacttgaccgacatggacaccaacggtgttatccacggtatg

SEQ ID NO: 261 - DNA, 1179 bp, Crocuta crocuta
atgaccacctactctgacaagggtcaaaagccagaaagaggtagattcttgcacttccactctgttaccttctgggttggtaacgctaagcaagctgcttctttctactgttctaagatgggtttcgaaccattggcttacaagggtttggaaaccggttctagagaagttgtttctcacgttgttaagcaaggtgaaatcgttttcgttttctgttctgctttgaacccatggaacaaggaaatgggtgaccacttggttaagcacggtgacggtgttaaggacatcgctttcgaagttgaagactgtgaatacatcgttcaaaaggctagagaaagaggtgctaagatcatcagagaaccatgggttgaacaagacaagttcggtaaggttaagttcgctgttttgcaaacctacggtgacaccacccacaccttggttgaaaagatgaactacaccggtagattcttgccaggtttcgaagctccagctttcaccgacccattgttgtctaagttgccacactgtaagttggaaatcatcgaccacatcgttggtaaccaaccagaccaagaaatgacctctgcttctgactggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagaagattgagagaaagaggtatggaattcttggctgttccatctacctactacaagcaattgagagaaaagttgaagaccgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaaaacttgagaggtaacttgaccgacatggaaaccaacggtgttatcaccggtatg

SEQ ID NO: 262 - DNA, 1290 bp, Hylobates moloch
atggaattcttgggtgctgctgctgaattggaaatgggttcttgtccaggtgctttgtctaccccagcttcttgtccagttttccaagctggttctttgaccaagatcaacatgaccacctactctgacaagggtcaaaagccagaaagaggtagattcttgcacttccactctgttaccttctgggttggtaacgctaagcaagctgcttctttctactgttctaagatgggtttcgaaccattggcttacaagggtttggaaaccggttctagagaagttgtttctcacgttgttaagcaaggtgaaatcgttttcgttttctgttctgctttgaacccatggaacaaggaaatgggtgaccacttggttaagcacggtgacggtgttaaggacatcgctttcgaagttgaagactgtgaatacatcgttcaaaaggctagagaaagaggtgctaagatcatcagagaaccatgggttgaacaagacaagttcggtaaggttaagttcgctgttttgcaaacctacggtgacaccacccacaccttggttgaaaagatgaactacaccggtagattcttgccaggtttcgaagctccaaccttcaccgacccattgttgtctaagttgccacactgtaagttggaaatcatcgaccacatcgttggtaaccaaccagaccaagaaatgacctctgcttctgactggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagaagattgagagaaagaggtatggaattcttggctgttccatctacctactacaagcaattgagagaaaagttgaagaccgctaagatcagagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaaaacttgagaggtaacttgaccgacatggaaaccaacggtgttatcaccggtatg

SEQ ID NO: 263 - DNA, 1236 bp, Sapajus apella
atgtgtagacaacaatctttcttcccaggtggttctttgcacttgagacaacaaggtcaacaagctgaaggtggtcaaggtttgtcttctggttctccaccaggttggccattggacccacacgaaccatgttgtaacccagttatccaagctgtttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggctaagcacggtgacggtgttaaggacatcgctttcgaagttgaagactgtgactacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggtcaattcttgccaggttacgaagctccagttttcatggacccattgttgccaaagttgccaaagtgttctttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaacacccaagacatcatcaccgctatcagacacttgagagaaagaggtatggaattcttgtctgttccatctacctactacaagcaattgagagaaaagttgaagaccgctaagatcaaggttaaggaaaacatcgacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaaaacttgagaggtaacttgtctgacttggaaaccaacggtgttgttccaggtatg

SEQ ID NO: 264 - DNA, 1179 bp, Mustela erminea
atgaccacctactctgacaagggtgctaagccagaaagaggtagattcttgcacttccactctgttaccttctgggttggtaacgctaagcaagctgcttctttctactgtaccaagatgggtttcgaaccattggcttacagaggtttggaaaccggttctagacaagttgtttctcacgttatcaagcaaggtcaaatcgttttcgttttgtcttctgctttgaacccaggtaacaaggaaatgggtgaccacttggttaagcacggtgacggtgttaaggacatcgctttcgaagttgaagactgtgactacatcgttcaaaaggctagagaaagaggtgctaagatcttgagagaaccatgggttgaacaagacaagttcggtaaggttaagttcgctgttttgcaaacctacggtgacaccacccacaccttggttgaaaagatgaactacaccggtagattcttgccaggtttcgaagctccaatgtctaaggacccattgttgtctaagttgccatcttgttctttggaaatcatcgaccacatcgttggtaaccaaccagaacaagaaatggtttctgcttctgaatggtacttgagaaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagacccacgacatcatctctgctatcagacacttgagagaaagaggtatggaattcttggctgttccagctacctactacaagcaattgagagaaaagttgagatctgctaagatcagagttaccgaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaaaacttgagaggtaacttgaccgacatggaaaccaacggtgttgttccaggtatg

SEQ ID NO: 265 - DNA, 1179 bp, Camelus ferus
atgaccacctacaccaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaacaagacaagttcggtaaggttaagttcgctgttttgcaaacctacggtgacaccacccacaccttggttgaaaagatcgactacaccggtagattcttgccaggtttcgaagctccaatctacaaggacaccttgttgccaaagttgccaagatgtaacttggaaatcatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccaccatcagacacttgagagaaagaggtatggaattcttggctgttccatcttcttactacaagttgttgagagaaaacttgaagaccgctaagatccaagttaaggaatctatggacgttttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaagctttgagaggtaacttgaccgacttggaaaccaacggtgttagatctggtatg

SEQ ID NO: 266 - DNA, 1131 bp, Phocoena sinus; identical to SEQ ID NO: 155

SEQ ID NO: 267 - DNA, 1128 bp, Lontra canadensis
tactgggacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaagaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccatcttgtaacttggaaatcatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgagaaccgaagacatcatcaccaccatcagacacttgagagaaagaggtatggaattcttggctgttccatcttcttactacagattgttgagagaaaacttgaagacctctaagatccaagttaaggaaaacatggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggt

SEQ ID NO: 268 - DNA, 1179 bp, Tyto alba; identical to SEQ ID NO: 149

SEQ ID NO: 269 - DNA, 1179 bp, Trachypithecus francoisi
atgaccacctacaccaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtgttctgctttgaacccatggaacaaggaaatgggtgaccacttggctaagcacggtgacggtgttaaggacatcgctttcgaagttgaagactgtgaatacatcgttcaaaaggctagagaaagaggtgctaagatcgttagagaaccatgggttgaacaagacaagttcggtaaggttaagttcgctgttttgcaaacctacggtgacaccacccacaccttggttgaaaaggttaactacaccggtagattcttgccaggtttcgaagctccaacctacaaggacaacttgttgccaaagttgccaagatgtaacttggaaatcatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccaccatcagacacttgagagaaagaggtatggaattcttggctgttccatcttcttactacaagatgttgagagaaaacttgaagagagctaagatccaagttaaggaatctttggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaagctttgagaggtaacttgaccgacttggaaaccaacggtgttagatctggtatg

SEQ ID NO: 270 - DNA, 1179 bp, Mirounga leonina
atgaccacctacaccaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcatcagagaaccatgggttgaagaagacaagttcggtaaggttaagttcgctgttttgcaaacctacggtgacaccacccacaccttggttgaaaagatcaactacaccggtagattcttgccaggtttcgaagctccaacctacaaggacaacttgttgccaaagttgtctagatgtaagttggaagttatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccaccatcagacacttgagagaaagaggtatggaattcttggctgttccatcttcttactacaagatgttgagagaaaacttgaagatcgctaagatccaagttaaggaatctatggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagaagaacaagctttgagaggtaacttgaccgacttggaaaccaacggtgttagatctggtatg

SEQ ID NO: 271 - DNA, 1179 bp, Arvicanthis niloticus
atgaccacctacaccaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttctgttctgctttgaacccatggaacaaggaaatgggtgaccacttggttaagcacggtgacggtgttaaggacatcgctttcgaagttgaagactgtgaccacatcgttcaaaaggctagagaaagaggtgctaagatcgttagagaaccatgggttgaagaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccaagatgtaacttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccaccatcagacacttgagagaaagaggtatggaattcttggctgttccatcttcttactacaagttgttgagagaaaacttgaagaccgctaagatccaagttaaggaatctttggacgttttggaagaattgaagatcttggttgactacgacgaaaagggttacttgttgcaaatcttcaccaagccaatgcaagacagaccaaccttgttcttggaagttatccaaagaagaaaccaccaaggtttcggtgctggtaacttcaactctttgttcaaggctttcgaagaagaacaagctttgagaggtaacttgaccgacatggaaaccaacggtgttagatctggtatg

SEQ ID NO: 272 - DNA, 1179 bp, Trachemys scripta elegans
atgaccacctacaacaacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgctatcaagcaaggtaagatcgttttcgttttgtgttctgctttgaacccatggaacaaggaaatgggtgaccacttggttaagcacggtgacggtgttaaggacatcgctttcgaagttgaagactgtgaccacatcgttcaaaaggctagagaaagaggtgctaagatcgttagagaaccatgggttgaagaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccaagatgtaacttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccaccatcagacacttgagagaaagaggtatggaattcttggctgttccatcttcttactacaagttgttgagagaaaacttgaagaccgctaagatccaagttaaggaatctttggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacatggaaaccaacggtgttagatctggtatg

SEQ ID NO: 273 - DNA, 1179 bp, Pan paniscus
atgacctcttacaccaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaccacatcgttcaaaaggctagagaaagaggtgctaagatcgttagagaaccatgggttgaacaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccaagatgtaacttggaaatcatcgaccacatcgttggtaaccaaccagaccaagaaatgcaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccaccatcagacacttgagagaaagaggtatggaattcttggctgttccatcttcttactacaagttgttgagagaaaacttgaagtctgctaagatccaagttaaggaatctatggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacatggaaaccaacggtgttagatctggtatg

SEQ ID NO: 274 - DNA, 1179 bp, Callithrix jacchus
atgacctcttacaccaacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttgtgttctgctttgaacccatggaacaaggaaatgggtgaccacttggttaagcacggtgacgctgttaaggacatcgctttcgaagttgaagactgtgaacacatcgttcaaaaggctagagaaagaggtgctaagatcgttagagaaccatgggttgaacaagacaagttcggtaaggttaagttcgctgttttgcaaacctacggtgacaccacccacaccttggttgaaaagatcaactacaccggtagattcttgccaggtttcgaagctccaacccacaaggacaccttgttgtctaagttgccatcttgtaacttggaagttatcgaccacatcgttggtaaccaaccagaccaagaaatgacctctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccaccatcagacacttgagagaaagaggtatggaattcttggctgttccatcttcttactacaagttgttgagaggtaacttgaagaccgctaagatccaagttaaggaatctatggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaaccaacggtgttagatctggtatg

SEQ ID NO: 275 - DNA, 1179 bp, Canis lupus dingo
atgacctcttacaccaacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaacaagacaagttcggtaaggttaagttcgctgttttgcaaacctacggtgacaccacccacaccttggttgaaaagatcaactacaccggtagattcttgccaggtttcgaagctccaatgcacaaggacaccttgttgtctaagttgccatcttgtaacttggaagttatcgaccacatcgttggtaaccaaccagaccaagaaatgttgtctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccaccatcagacacttgagagaaagaggtatggaattcttggctgttccatcttcttactacagattgttgagagaaaacttgaagaccgctaagatccaagttaaggaatctatggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaaccaacggtgttagatctggtatg

SEQ ID NO: 276 - DNA, 1179 bp, Rhinolophus ferrumequinum
atgaccacctacaccaacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaagaagacaagttcggtaaggttaagttcgctgttttgcaaacctacggtgacaccacccacaccttggttgaaaagatcaactacaccggtcacttcttgccaggtttcgaagctccagtttacaaggacaccttgttgccaaagttgccaagatgtaacttggaagttatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgacgacatcatcaccgctatccaccacttgagagaaagaggtatggaattcttggctgttccatcttcttactacaagttgttgagagaaaacttgaagaccgctaagatccaagttaaggaatctatggacaccttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaaccaacggtgttagatctggtaag

SEQ ID NO: 277 - DNA, 1179 bp, Rhinolophus ferrumequinum
atgaccacctacaccaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaacaagacaagttcggtaaggttaagttcgctgttttgcaaacctacggtgacaccacccacaccttggttgaaaagatcaactacaccggtagattcttgccaggtttcgaagctccagtttacaaggacaccttgttgccaaagttgccaagatgtaacttggaagttatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgacgacatcatcaccgctatcagacacttgagagaaagaggtatggaattcttggctgttccatcttcttactacaagttgttgagagaaaacttgaagaccgctaagatccaagttaaggaatctttggacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaaccaacggtgttagatctggtatg

SEQ ID NO: 278 - DNA, 1179 bp, Phyllostomus discolor
atgaccacctacaacaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaccacatcgttcaaaaggctagagaaagaggtgctaagatcgttagagaaccatgggttgaacaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccaagatgtaacttggaaatcatcgaccacatcgttggtaaccaaccagaccaagaaatgcaatctgcttctgaatggtacttgaagaacttgcaatctcacagattctggtctgttgacgacacccaagttcacaccgaatactcttctttgagatctatcgttgttaccaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtaccgaattcttggctgctccatcttcttactacaagttgttgagagaaaacttgaagtctgctaagatccaagttaaggaatctatggacgttttggaagaattgcacatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaccaaacggtgttagatctggtatg

SEQ ID NO: 279 - DNA, 1179 bp, Halichoerus grypus
atgaccacctacaacaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtgaccacatcgttcaaaaggctagagaaagaggtgctaagatcgttagagaaccatgggttgaacaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccaagatgtaacttggaaatcatcgaccacatcgttggtaaccaaccagaccaagaaatgcaatctgcttctgaatggtacttgaagaacttgcaattccacagattctggtctgttgacgacacccaagttcacaccgaatactcttctttgagatctatcgttgttaccaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtaccgaattcttggctgctccatcttcttactacaagttgttgagagaaaacttgaagtctgctaagatccaagttaaggaatctatggacgttttggaagaattgcacatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaccaaacggtgttagatctggtatg

SEQ ID NO: 280 - DNA, 1179 bp, Onychomys torridus
atgaccacctacaacaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagagaggtaagatcgttttcgttttgtgttctgctttgaacccatggaacaaggaaatgggtgaccacttggttaagcacggtgacggtgttaaggacatcgctttcgaagttgaagactgtgaccacatcgttcaaaaggctagagaaagaggtgctaagatcgttagagaaccatgggttgaacaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccaagatgtaacttggaaatcatcgaccacatcgttggtaaccaaccagaccaagaaatgcaatctgcttctgaatggtacttgaagaacttgcaattccacagattctggtctgttgacgacacccaagttcacaccgaatactcttctttgagatctatcgttgttaccaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtaccgaattcttggctgctccatcttcttactacaagttgttgagagaaaacttgaagtctgctaagatccaagttaaggaatctatggacgttttggaagaattgcacatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaccaaacggtgttagatctggtatg

SEQ ID NO: 281 - DNA, 1137 bp, Rousettus aegyptiacus
accgttgactactgggacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacatcgctttcgaagttgaagactgtaaccacatcgttcaaaaggctagagaaagaggtgctaagatcgttagagacgcttgggttgaacaagacaagttcggtaaggttaagttcgctgttttgcaaacctacggtgacaccacccacaccttggttgaaaagatcaactacaccggtagattcttgccaggtttcgaagctccaacctacaaggacaccttgttgccaaagttgccaagatgtaacttggaaatcatcgaccacatcgttggtaaccaaccagaccaagaaatgcaatctgcttctgaatggtacttgaagaacttgcaattccacagattctggtctgttgacgacacccaagttcacaccgaatactcttctttgagatctatcgttgttaccaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtaccgaattcttggctgctccatcttcttactacaagttgttgagagaaaacttgaagtctgctaagatccaagttaaggaatctatggacgttttggaagaattgcacatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggt

SEQ ID NO: 282 - DNA, 1179 bp, Molossus molossus
atgaccacctacaccaacaagggtccaaagccagaaagaggtagattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtgttctgctttgaacccatggaacaaggaaatgggtgaccacttggttaagcacggtgacggtgttaaggacgttgctttcgaagttgaagactgtgaccacatcgttcaaaaggctagagaaagaggtgctaagatcgttagagaaccatgggttgaacaagacaagttcggtaaggttaagttcgctgttttgcaaacctacggtgacaccacccacaccttggttgaaaagatcaactacaccggtagattcttgccaggtttcgaagctccaatctacaaggacaccttgttgccaaagttgccaagatgtaacttggaaatcatcgaccacatcgttggtaaccaaccagaccaagaaatgcaatctgcttctgaatggtacttgaagaacttgcaattccacagattctggtctgttgacgacacccaagttcacaccgaatactcttctttgagatctatcgttgttaccaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccgctatcagacacttgagagaaagaggtatcgaattcttggctgttccatcttcttactacaagttgttgagagaaaacttgaagtctgctaagatccaagttaaggaaaacatggacatcttggaagaattgcaaatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaaccaaacggtgttagatctggtatg

SEQ ID NO: 283 - DNA, 1179 bp, Myotis myotis
atgaccacctactctaacagaggtccaaagccagaaagaggtcaattcttgcacttccactctgttaccttctgggttggtaacgctaagcaagctgcttctttctactgtaacaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaagaagacaagttcggtaaggttaagttcgctgttttgcaaacctacggtgacaccacccacaccttggttgaaaagatcaactacaccggtagattcttgccaggtttcgaagctccagcttacaaggacatcttgttgtctaagttgccaaactgtcacttggaaatcatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcaccaccatcagacacttgagagaaagaggtatggaattcttggctgttccatcttcttactacaagttgttgagagaaaacttgaagaccgctaagatccaagttaaggaatctatgaacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaacaagaacaagctttgagaggtaacttgaccgacttggaaaccaacggtgttagatctggtatg

SEQ ID NO: 284 - DNA, 1179 bp, Pipistrellus kuhlii
atgaccacctactctaacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttgtgttctgctttgaacccatggaacaaggaaatgggtaaccacttggttaagcacggtgacggtgttaaggacatcgctttcgaagttgaagactgtgaccacatcgttcaaaaggctagagaaagaggtgctaagatcgttagagaaccatgggttgaacaagacaagttcggtaaggttaagttcgctgttttgcaaacctacggtgacaccacccacaccttggttgaaaagatgaactacaccggttgtttcttgccaggtttcgaagctccaacctacaaggacccattgttgtctaagttgccaaactgtaacttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagaccgaagacatcatcaccgctatcagacacttgagagaaagaggtatggaattcttggctgttccatcttcttactacaagttgttgagagaaaacttgaagaccgctagaatccaagttaaggaatctatcgacgttttggaagaattgaagatcttggttgactacgacgacaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacaccggtaccaacagagttatgtctggtatg

SEQ ID NO: 285 - DNA, 1179 bp, Balaenoptera musculus
atgaccacctactctgacaagggtccaaagccagaaagaggtagattcttgcacttccactctgttaccttctgggttggtaacgctaagcaagctgcttctttctactgtaacaagatgggtttcgaaccattggcttacaagggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgaacacatcgttcaaaaggctagagaaagaggtgctaagatcgttagagaaccatgggttgaacaagacagattcggtaaggttaagttcgctgttttgcaaacctacggtgacaccacccacaccttggttgaaaagatcaactacaccggtagattcttgccaggtttcgaagctccaatgttgaaggacccattgttgtctaagttgccaaactgttctttggaaatcatcgaccacatcgttggtaaccaaccagaccaagaaatggaatctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaccaccatcagacacttgagagaaagaggtatggaattcttggctgttccatctacctactacaagttgttgagagaaaacttgaagtctgctaagatcagagttaaggaatctatcgacgttttggaagaattgaagatcttggttgactacgacgaaaacggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacatggaaaccaacggtgttgtttctggtatg

SEQ ID NO: 286 - DNA, 1260 bp, Manis pentadactyla
atgagaccaagattggaccaaaagttgccaggtttgggtccatgtagaccaagattgtcttctagaccacacgaaggtcaccaaaccacctactctaacaagggtccaaagccagaaagaggtagattcttgcacttccactctgttaccttctgggttggtaacgctaagcaagctgcttctttctactgtaacaagatgggtttcgaaccattcgcttacagaggtttggaaaccggtgctagagaagttgtttctcacgttatcaagcaaggtaagatcgttttcgttttgtcttctgctttgaacccatggaacaaggaaatgggtgaccacttggttaagcacggtgacggtgttaaggacatcaccttcgaagttgaagactgtgactctatcgttcaaaaggctagagaaagaggtgctaagatcgttagagaaccatgggttgaacaagacaagttcggtaaggttaagttcgctgttttgcaaacctacggtgacaccacccacaccttggttgaaaaggttaactacaccggtagattcttgccaggtttcgaagctccagttatgaccgacccattgttgtctaagttgccaaactgtcacttggaaatcatcgaccacatcgttggtaaccaaccagaccaagaaatggtttctgcttctgaatggtacttgaagaacttgcaattccacagattctggtctgttgacgacaagcaagttcacaccgaatactcttctttgagatctgttgttgttgctaactacgaagaatctatcaagatgccaatcaacgaaccagctccaggtaagaagaagtctcaaatccaagaattcgttgaatacaacggtggtgctggtgttcaacacatcgctttgaagacccaagacatcatcacctctatcagacacttgagagaaagaggtaccgaattcttggctgttccatctacctactacaagcaaatcagagaaaagttgaagaccgctaagatcaaggttaaggaaaacatcgacatcttggaagaattgagaatcttggttgactacgacgaaaagggttacttgttgcaaatcttcaccaagccaatgcaagacagaccaaccttgttcttggaaatcatccaaagacacaaccaccaaggtttcggtgctggtaacttcaacgctttgttcaaggctttcgaagaagaacaagacttgagaggtaacttgatcgacgttaacaccaacggtgttgttccaggtatg

SEQ ID NO: 287 - DNA, 1179 bp, Manis javanica
atgaccacctactctgacaagggtcaaaagccagaaaagggtagattcttgcacttccactctgttaccttctgggttggtaacgctaagcaagctgcttctttctactgttctaagatgggtttcgaaccattggcttacaagggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttcaagaaccatgggttgaacaagacaagttcggtaaggttaagttcgctgttttgcaaacctacggtgacaccacccacaccttggttgaaaagatgaactacaccggtagattcttgccaggtttcgaagctccaaccttcaaggacccattgttgtctaagttgccaaactgtaacttggaaatcatcgaccacatcgttggtaaccaaccagaccaagaaatggtttctgcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcgctgctatcagacacttgagagaaagaggtatggaattcttggctgttccaccaacctactacaagcaattgagagaaaacttgaagttggctaagatccaagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagctttgagaggtaacttgaccgacttggaagctaacggtatggtttctggtatg

SEQ ID NO: 288 - DNA, 1179 bp, Sturnira hondurensis
atgaccacctactctgacaagggtgctaagccacaaagaggtagattcttgcacttccactctgttaccttctgggttggtaacgctaagcaagctgcttctttctactgttctaagatgggtttcgaaccattggcttacaagggtttggaaaccggttctagagaagttgtttctcacgttatcagacaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaaaaggacaagttcggtaaggttaagttcgctgttttgcaaacctacggtgacaccacccacaccttggttgaaaagatgaactacaccggtagattcttgccaggtttcgaagctccaacctacgttgacccacacttggctaagttgccagactgtaacttggaaatcatcgaccacatcgttggtaaccaaccagaccaagaaatggtttctgcttctgaatggtacttgagaaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccacgacatcatcaccgctatcagacacttgagagaaagaggtatggaattcttggctgttccatctacctactacagacaattgagagaaggtttgaagtctgctaagatccaagttaaggaatctatcgacgctttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaactctttgttcaaggctttcgaagaagaacaagctttgagaggtaacttgaccgacttggaaaccaacggtgttgctttgggtatg

SEQ ID NO: 289 - DNA, 1173 bp, Talpa occidentalis
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttatcaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaacaaggtgctaagatcgttagagaaccatgggttgaacaagacaagttcggtaaggttaagttcgctgttttgcaaacctacggtgacaccacccacaccttggttgaaaagatgaactacaccggtagattcttgccaggtttcgaagctccaaccttcaaggacccattgttgtctaagttgccaaagtgttctttggaaatcatcgaccacatcgttggtaaccaaccagaccaagaaatggttccagcttctgaatggtacttgaagaacttgcaattccacagattctggtctgttgacgacacccaagttcacaccgaatactcttctttgagatctatcgttgttgctaactacgaagaatctatcaagatgccaatcaacgaaccagctccaggtagaaagaagtctcaaatccaagaatacgttgactacaacggtggtgctggtgttcaacacatcgctttgaagaccgaagacatcatcatggctatcagacacttgagagaaagaggtatggaattcttggctgttccatctacctactacagacaattgagagaaaacttgaagaccgctaagatccaagttaaggaatctatcgacgttttggaagaattgaagatcttggttgactacgacgaaaagggttacttgttgcaaatcttcaccaagccaatgcaagacagaccaaccttgttcttggaagttatccaaagaagaaaccaccaaggtttcggtgctggtaacttcaactctttgttcaaggctttcgaagaagaacaagacttgagaggtaacttgaccgacttggaaccaaacggtgttgtttct

SEQ ID NO: 290 - DNA, 1179 bp, Choloepus didactylus
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgtttctcacgttgttaagcaaggtaagatcgttttcgttttgtcttctgctttgaacccatggaacaaggaaatgggtgaccacttggttaagcacggtgacggtgttaaggacatcgctttcgaagttgaagactgtgactacatcgttcaaaaggctagagaaagaggtgctaagatcgttagagaaccatgggttgaagaagacaagttcggtaaggttaagttcgctgttttgcaaacctacggtgacaccacccacaccttggttgaaaagatgaactacaccggtagattcttgccaggtttcgaagctccaaccttcatggacccattgttgtctaagttgccatcttgtaccttggaaatcatcgaccacatcgttggtaaccaaccagaccaagaaatgttgtctgcttctgactggtacttgaagaacttgcaattccacagattctggtctgttgacgacacccaagttcacaccgaatactcttctttgagatctatcgttgttgctaactacgaagaatctatcaagatgccaatcaacgaaccagctccaggtaagaagaagtctcaaatccaagaatacgttgactacaacggtggtgctggtgttcaacacatcgctttgaagacccaagacatcatcaaggctatcagacacttgagagaaagaggtatggaattcttggctgttccatctgcttactacagacaattgagagaaaacttgaagaccgctaagatcagagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaactctttgttcaaggctttcgaagaagaacaagacttgagaggtaacttgaccgacgttgaaaccaacggtttggttagaggtatg

SEQ ID NO: 291 - DNA, 1179 bp, Chlorocebus sabaeus
atgaccacctactctgacaagggtgctaagccagaaagaggtagattcttgcacttccactctgttaccttctgggttggtaacgctaagcaagctgctgctttctactgttctaagatgggtttcgaaccattggcttacagaggtttggaaaccggttctagagaagttgcttctcacgttatcaagcaaggtcaaatcgttttcgttttgtcttctccattgaacccatggaacagagaaatgggtgaacacttggttaagcacggtgactctgttaaggacatcgctttcgaagttgaagactgtgactacatcgttcaaaaggctagagaaagaggtgctaaggttgttagagaaccatgggttgaagaagacaagttcggtaaggttaagttggctgttttgcaaacctacggtgacaccacccacaccttggttgaaaagatgtctttctctggttctttcttgccaggtttcgaagctccaagagttaaggactctttgttgtctaagttgccatcttgtggtttggaaaccatcgaccacatcgttggtaaccaaccagaccaagaaatggtttctgcttctgaatggtacttgagaaacttgcaattccacagattctggtctgttgacgactctcaagttcacaccgaatactctgctttgagatctatcgttgttaccaactacgaagaatctatcaagatgccaatcaacgaaccagctttgggtagaaagaagtctcaaatccaagaatacgttgaatacaacggtggtgctggtgttcaacacatcgctttgaagaccccagacatcatcacctctatcagacacttgagagaaagaggtgttgaattcttggctgttccatctacctactacaagcaattgagagaaaacttgaagtctgctaagatcagagttaaggaatctatcgacatgttggaagaattgaagatcttggttgactacgacgaaaagggttacttgttgcaagttttcaccaagccagttcaagacagaccaaccttgttcttggaagttatccaaagacacaaccaccaaggtttcggtgctggtaacttcaacgctttgttcaaggctttcgaagctgaacaagacttgagaggtaacttgaccgacaccgaaaccaacggtgttgtttctggtgtt

SEQ ID NO: 292 - DNA, 1179 bp, Chlorocebus sabaeus
atgaccacctactctgacaagggtgctaagccagaaagaggtagattcttgcacttccactctgttaccttctgggttggtaacgctaagcaagctgctgctttctactgttctaagatgggtttcgaaccattggcttacagaggtttggaaaccggttctagagaagttgcttctcacgttatcaagcaaggtcaaatcgttttcgttttgtcttctccattgaacccatggaacagagaaatgggtgaacacttggctaagcacggtgactctgttaaggacatcggtttcgaagttgaagactgtgactacatcgttcaaaaggctagagaaagaggtgctaaggttgttagagaaccatgggttgaacaagacaagttcggtaaggttaagttcgctgttttgcaaacctacggtgacaccacccacaccttggttgaaaaggttaactactctggttctttcttgccaggtttcgaagctccaagagctaaggacccattgttggctaagttgccatcttgttctttggaaatgatcgaccacatcgttggtaaccaaccagaccaagaaatggtttctgcttctgaatggtacttgagatctttgcaattccacagattctggtctgttgacgacacccaagttcacaccgaatactcttctttgagatctatcgttgttaccaactacgaagaatctatcaagatgccaatcaacgaaccagctccaggtaagaagaagtctcaaatccaagaatacgttgactacaacggtggtgctggtgttcaacacatcgctttgggtacccaagacatcatcacctctatcagacacttgagagaaagaggtgttgaattcttggctgttccatctacctactacaagcaattgagagaaaacttgaagtctgctaaggttcaagttaaggaatctatcgacatgttggaagaattgaagatcttggttgactacgacgaaaagggttacttgttgcaaatcttcaccaagccagttcaagacagaccaaccttgttcttggaagttatccaaagacacaaccaccaaggtttcggtgctggtaacttcaacgctttgttcaaggctttcgaagctgaacaagacttgagaggtaacttgaccgacgttgaaaccaacggtgttgaatctggtttg

SEQ ID NO: 293 - DNA, 1230 bp, Arvicola amphibius
atgccatggccaccaggtaccgtttcttgggaagctagaccaagaccagctatgaccacctactctgacaagggtgaaaagccagaaagaggtagattcttgcacttccactctgttaccttctgggttggtaacgctaagcaagctgctgctttctactgttctaagatgggtttcgaaccattggcttacagaggtttggaaaccggttctagagaagttgcttctcacgttatcaagcaaggtcaaatcgttttcgttttctcttctccattgaacccaggtaacaaggaattgggtgaccacttggttaagcacggtgacggtgttaaggacatcgctttcgaagttgaagactgtgactacatcgttcaaaaggctagagaaagaggtgctaaggttgttagagaaccatgggttgaacaagacagattcggtaaggttaagttcgctgttttgcaaacctacggtgacaccacccacaccttggttgaaaagaccggttacaccggttctttcttgccaggtttcgaagctccaagagttaaggactctttgttgtctaagttgccaaactgtggtttggaaatcatcgaccacgttgttggtaaccaaccagaccaagaaatgttgtctgcttctgaatggtacttgaagaacttgcaattccacagattctggtctgttgacgacacccaagttcacaccgaatactcttctttgagatctatcgttgttaccaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtgctgaattcttggctgttccatctacctactacaagcaattgagagaaaacttgaagtctgctaaggttcaagttaaggaaaacatcgacatgttggaagaattgagaatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagctgaacaagacttgagaggtaacttgaccgacttggaaccaaacggtgttgcttctggtatg

SEQ ID NO: 294 - DNA, 1179 bp, Tachyglossus aculeatus
atgaccacctactctgacaagggtgctaagccagaaagaggtagattcttgcacttccactctgttaccttctgggttggtaacgctaagcaagctgcttctttctactgttctaagatgggtttcgaaccattggcttacagaggtttggaaaccggttctagagaagttgcttctcacgttatcaagcaaggtcaaatcgttttcgttttctcttctccattgaacccatggaacaaggaaatgggtgaccacttggttaagcacggtgacggtgttaaggacatcgctttcgaagttgaagactgtgactacatcgttcaaaaggctagagaaagaggtgctaaggttgttagagaaccatgggttgaacaagacaagtctggtaaggttaagttcgctgttttgcaaacctacggtgacaccacccacaccttggttgaaaagaccggttactctggttctttcttgccaggtttcgaagctgctagagctaaggactctttgttgtctaagttgccatcttgtggtttggaaatcatcgaccacatcgttggtaaccaaccagaccaagaaatgttgtctgcttctgaatggtacttgagaaacttgcaattccacagattctggtctgttgacgacacccaagttcacaccgaatactcttctttgagatctatcgttgttaccgactacgaagaatctatcaagatgccaatcaacgaaccagctccaggtaagaagaagtctcaaatccaagaatacgttgactacaacggtggtgctggtgttcaacacatcgctttgaagacccaagacatcatcaccgctatcagacacttgagagaaagaggtgctgaattcttggctgttccatcttcttactacacccaattgagagaaaacttgaagtctgctaaggttagagttaaggaaaacatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagctgaacaagacttgagaggtaacttgaccgacttggaaaccaacggtgttgcttctggtatg

SEQ ID NO: 295 - DNA, 1179 bp, Canis lupus familiaris
atgaccacctactctgacaagggtgctaagccagaaagaggtagattcttgcacttccactctgttaccttctgggttggtaacgctaagcaagctgctgcttactactgttctaagatgggtttcgaattgttggcttacagaggtttggaaaccggttctagagaagttgcttctcacgttatcaagcaaggtcaaatcgttttcgttttctcttctccattgaacccatggaacaaggaaatgggtgaccacttggttaagcacggtgacggtgttaaggacatcgctttcgaagttcaagactgtgactacatcgttcaaaaggctagagaaagaggtgctaaggttgttagagaaccatgggttgaacaagacaagttcggtaaggttaagttcgctgttttgcaaacctacggtgacaccacccacaccttggttgaaaagatgtcttacaccggttctttcttgccaggtttcgaagctccaagagttaaggacgctttgttgttcaagttgccatcttgtggtttggaaatcatcgaccacatcgttggtaaccaaccagaccaagaaatggcttctgcttctgaatggtacttgagaaacttgcaattccacagattctggtctgttgacgacacccaagttcacaccgaatactcttctttgagatctatcgttgttaccaactacgaagaatctatcaagatgccaatcaacgaaccagctccaggtagaaagaagtctcaaatccaagaatacgttgactacaacggtggtgctggtgttcaacacatcgctttgaagacccaagacatcatcaccgctatcagacacttgagagaaagaggtgctgaattcttggctgttccatcttcttactacagacaattgagagaaaacttgaagtctgctaaggttagagttaaggaatctatcgacgttttggaagaattgaagatcttggttgactacgacgaaaagggttacttgttgcaaatcttcaccaagccaatgcaagacagaccaaccttgttcttggaagttatccaaagacacaaccaccaaggtttcggtgctggtaacttcaacgctttgttcaaggctttcgaagctgaacaagacttgagaggtaacttgaccgacttggaaaccaacggtgaagtttctggtatg

SEQ ID NO: 296 - DNA, 1182 bp, Eschrichtius robustus
atgaccacctactctgacaagggtgttaagccagaaagaggtagattcttgcacttccactctgttaccttctgggttggtaacgctaagcaagctgcttctttctactgttctaagatgggtttcaagccattggcttacagaggtttggaaaccggttctagagaagttgtttctcacgttatcaagcacggtaagatcgttttcgttttgtcttctgctttgaacccatggaacaaggaaatgggtgaccacttggttaagcacggtgacggtgttaaggacatcgctttcgaagttgaagactgtaactacatcgttcaaaaggctagagaaagaggtgctaagatcgttagagaaccatgggttgaacaagacaagtgtggtagagttaagttcgctgttttgcaaacctacggtgacaccacccacaccttggttgaaaagatcaactacaccggttgtttcttgccaggtttcgaagctccaaccttcatggacccattgttgtctaagttgccatcttgtaacttggaaatcatcgaccacatcgttggtaaccaaccagaccaagaaatggcttctgcttctgaatggtacttgaagaacttgcaattccacagattctggtctgttgacgacacccaagttcacaccgaatactcttctttgagatctatcgttgttaccaactacgaagaatctatcaagatgccaatcaacgaaccagctccaggtaagaagaagtctcaaatccaagaatacgttgactacaacggtggtgctggtgttcaacacatcgctttgagaacccaagacatcatcaccgctatcagacacttgaaggaaagaggtatggaattcttggctgttccatctacctactacaagcaattgagagaaaagttgaagtctgctaaggttcaagttaaggaatctatcgacgttttggaagaattgaagatcttggttgactacgacgaaaagggttacttgttgcaaatcttcaccaagccagttcaagacagaccaaccttgttcttggaagttatccaaagaaacaaccaccaaggtttcggtgctggtaacttcaactctttgttcaaggctttcgaagaagaacaaaacttgagaggtaacttgaccgacttggaatctaaccaaccaggtagagctagacac

What is claimed is:

1. A non-natural enzyme capable of producing beta-hydroxyisovalerate (βHIV), the non-natural enzyme comprising one or more amino acid modifications or mutations relative to a corresponding enzyme lacking the substitutions, wherein the non-natural enzyme comprises one or more modifications or mutations at substrate-specificity positions corresponding to amino acids selected from V212, L224, Q251 and F371, of any of SEQ ID NO: 1 or SEQ ID NO: 6, and wherein the non-natural enzyme is modified or mutated to provide more beta-hydroxyisovalerate (βHIV) synthase activity than a corresponding enzyme with the same amino acid sequence lacking the one or more amino acid modifications or mutations.

2. The non-natural enzyme of claim 1, wherein the non-natural enzyme is at least 65% identical to at least one polypeptide selected from the group consisting of SEQ ID NOS: 1-148.

3. The non-natural enzyme of claim 1, wherein the non-natural enzyme is at least 65% identical to at least one polypeptide selected from the group consisting of SEQ ID NOS: 1-6.

4. The non-natural enzyme of claim 1, wherein the non-natural enzyme comprises two or more modifications or mutations at substrate-specificity positions corresponding to amino acids selected from V212, L224, Q251 and F371, of SEQ ID NO: 1 or SEQ ID NO: 6.

5. The non-natural enzyme of claim 4, wherein the two or more modifications or mutations comprises altering two or more of the substrate-specificity positions corresponding to amino acids selected from the group consisting of Q251 and F371 or V212 and L224, of SEQ ID NO: 1 or SEQ ID NO: 6.

6. The non-natural enzyme of claim 1, wherein the one or more modifications or mutations comprises one or more substrate-specificity position modifications or mutations selected from the group of methionine at position 224, proline at position 251, and leucine at position 212, of SEQ ID NO: 1 or SEQ ID NO: 6.

7. A modified microorganism expressing the non-natural enzyme of claim 1.

8. The modified microorganism of claim 7, wherein the modified microorganism expresses or overexpresses at least one gene encoding for βHIV synthase having at least 65% identity to the group consisting of SEQ ID NOS: 1-148.

9. The modified microorganism of claim 8, wherein the modified microorganism comprises a βHIV metabolic pathway in the cytosol.

10. The modified microorganism of claim 7, wherein the modified microorganism comprises an active βHIV metabolic pathway from pyruvate to βHIV comprising (i) pyruvate into acetolactate, (ii) acetolactate into 2,3-dihydroxyisovalerate, (iii) 2,3-dihydroxyisovalerate into α-ketoisovalerate, (iv) α-ketoisovalerate into α-isopropylmalate, (v) α-isopropylmalate into β-isopropylmalate, (vi) β-isopropylmalate into α-ketoisocaproate, and (vii) α-ketoisocaproate into βHIV.

11. The modified microorganism of claim 7, wherein the modified microorganism comprises an active βHIV metabolic pathway from pyruvate to βHIV comprising (i) pyruvate into acetolactate, (ii) acetolactate into 2,3-dihydroxyisovalerate, (iii) 2,3-dihydroxyisovalerate into α-ketoisovalerate, (iv) α-ketoisovalerate into 2-isopropylmalate, (v) 2-isopropylmalate into 2-isopropylmaleate, (vi) 2-isopropylmaleate into 3-isopropylmalate, (vii) 3-isopropylmalate into 2-isopropyl-3-oxosuccinate, (viii) 2-isopropyl-3-oxosuccinate into α-ketoisocaproate, and (ix) α-ketoisocaproate into βHIV.

12. The modified microorganism of claim 7, wherein the modified microorganism is a yeast or a bacteria.

13. The modified microorganism of claim 7, wherein the modified microorganism is a yeast selected from the group consisting of *Saccharomyces, Kluyveromyces, Pichia, Issatchenkia, Hansenula,* or *Candida.*

14. The modified microorganism of claim 7, wherein the modified microorganism is a prokaryotic bacterium, wherein the prokaryotic bacterium is selected from a Gram-positive bacterium or a Gram-negative bacterium, the Gram-positive bacterium comprising *Corynebacterium, Lactobacillus, Lactococcus* or *Bacillus,* and the Gram-negative bacteria comprising *Escherichia* or *Pseudomonas.*

15. A method of producing beta-hydroxyisovalerate (βHIV) using a non-natural enzyme expressed in a microorganism, the method comprising:
  providing a non-natural enzyme expressed in a microorganism, the non-natural enzyme comprising one or more amino acid modifications or mutations relative to a corresponding enzyme lacking the substitutions, wherein the non-natural enzyme comprises one or more modifications or mutations at substrate-specificity positions corresponding to amino acids selected from V212, L224, Q251 and F371, of any of SEQ ID NO: 1 or SEQ ID NO: 6, and wherein the non-natural enzyme is modified or mutated to provide more beta-hydroxyisovalerate synthase activity than a corresponding enzyme with the same amino acid sequence lacking the one or more amino acid modifications or mutations;
  cultivating the microorganism in a culture containing a feedstock of a carbon source until a recoverable quantity of βHIV is produced; and
  recovering the recoverable quantity of produced βHIV.

16. The method of claim 15, further comprising purifying the recoverable quantity of βHIV.

17. The method of claim 15, wherein the microorganism comprises a βHIV metabolic pathway cultivated in the culture medium containing a feedstock of a carbon source to produce βHIV.

18. The method of claim 17, wherein the carbon source is selected from the group consisting of glucose, xylose, arabinose, sucrose, fructose, lactose, glycerol, and mixtures thereof.

19. The method of claim 15, wherein the microorganism cultivated in the culture produces βHIV at a yield of at least about 0.1 percent up to 100 percent of theoretical yield.

20. The method of claim 15, wherein the microorganism comprises a βHIV metabolic pathway in contact with a carbon source in a fermenter to produce βHIV, wherein the fermenter introduces sufficient nutrients such that a final βHIV concentration in a fermentation broth is greater than about 10 mg/L.

* * * * *